US012668645B2

(12) United States Patent
Wei et al.

(10) Patent No.: US 12,668,645 B2
(45) Date of Patent: Jun. 30, 2026

(54) ANTIGEN BINDING POLYPEPTIDES, ANTIGEN BINDING POLYPEPTIDE COMPLEXES AND METHODS OF USE THEREOF

(71) Applicant: ModeX Therapeutics, Inc., Weston, MA (US)

(72) Inventors: Ronnie Rong Wei, Weston, MA (US); Ling Xu, Newton Center, MA (US); Zhi-Yong Yang, Newton Center, MA (US); Edward Seung, Medford, MA (US); Gary J. Nabel, Delray Beach, FL (US)

(73) Assignee: ModeX Therapeutics, Inc., Weston, MA (US)

( * ) Notice: Subject to any disclaimer, the term of this patent is extended or adjusted under 35 U.S.C. 154(b) by 0 days.

(21) Appl. No.: 17/936,047

(22) Filed: Sep. 28, 2022

(65) Prior Publication Data

US 2023/0227553 A1     Jul. 20, 2023

Related U.S. Application Data

(60) Provisional application No. 63/292,382, filed on Dec. 21, 2021, provisional application No. 63/291,305, (Continued)

(51) Int. Cl.
| | |
|---|---|
| *C07K 16/46* | (2006.01) |
| *A61P 31/12* | (2006.01) |
| *A61P 35/00* | (2006.01) |
| *C07K 16/082* | (2026.01) |
| *C07K 16/087* | (2026.01) |
| *C07K 16/10* | (2006.01) |
| *C07K 16/1203* | (2026.01) |
| *C07K 16/1267* | (2026.01) |

(Continued)

(52) U.S. Cl.
CPC ............ *C07K 16/468* (2013.01); *A61P 31/12* (2018.01); *A61P 35/00* (2018.01); *C07K 16/082* (2013.01); *C07K 16/087* (2013.01); *C07K 16/1009* (2013.01); *C07K 16/1018* (2013.01); *C07K 16/1027* (2013.01); *C07K 16/1063* (2013.01); *C07K 16/1081* (2013.01); *C07K 16/125* (2013.01); *C07K 16/1253* (2013.01); *C07K 16/1275* (2013.01); *C07K 16/1285* (2013.01); *C07K 16/2803* (2013.01); *C07K 16/2809* (2013.01); *C07K 16/2818* (2013.01); *C07K 16/2866* (2013.01); *C07K 16/2878* (2013.01); *C07K 16/2887* (2013.01); *C07K 16/3076* (2013.01); *C07K 19/00* (2013.01); *C07K 2317/21* (2013.01); *C07K 2317/24* (2013.01); *C07K 2317/31* (2013.01); *C07K 2317/73* (2013.01); *C07K 2317/92* (2013.01); *C07K 2319/41* (2013.01); *C07K 2319/42* (2013.01); *C07K 2319/43* (2013.01)

(58) Field of Classification Search
CPC .. C07K 16/468; C07K 16/082; C07K 16/087; C07K 16/1009; C07K 16/1018; C07K 16/1027; C07K 16/1063; C07K 16/1081; C07K 16/125; C07K 16/1253; C07K 16/1275; C07K 16/1285; C07K 16/2803; C07K 16/2809; C07K 16/2818; C07K 16/2866; C07K 16/2878; C07K 16/2887; C07K 16/3076; C07K 19/00; C07K 2317/21; C07K 2317/24; C07K 2317/31; C07K 2317/73; C07K 2317/92; C07K 2319/41; C07K 2319/42; C07K 2319/43; C07K 2317/62; C07K 2317/622; C07K 16/46; C07K 2319/50; C07K 2317/64; C07K 2317/71; C07K 16/2896; C07K 16/00; C07K 2317/626; C07K 2317/56; A61P 31/12; A61P 35/00; C12N 2502/30; C12N 5/0636
See application file for complete search history.

(56) References Cited

U.S. PATENT DOCUMENTS 7,129,330 B1    10/2006 Little et al.
7,951,917 B1     5/2011 Arathoon et al.
(Continued)

FOREIGN PATENT DOCUMENTS

EP          0979281 B1      7/2005
EP          1293514 B1     11/2006
(Continued)

OTHER PUBLICATIONS

Bendig, MM, "Humanization of Rodent Monoclonal Antibodies by CDR Grafting", 1995, Methods: A Companion to Methods in Enzymology, 8, 83-93. (Year: 1995).*
(Continued)

*Primary Examiner* — Laura B Goddard
*Assistant Examiner* — Alyssa Rae Stonebraker
(74) *Attorney, Agent, or Firm* — Sterne, Kessler, Goldstein & Fox P.L.L.C.

(57)     ABSTRACT

Disclosed are antigen binding polypeptides and antigen binding polypeptide complexes (e.g., antibodies and antigen binding fragments thereof) having certain structural features. Also disclosed are polynucleotides and vectors encoding such polypeptides and polypeptide complexes; host cells; chimeric antigen receptors (CARs); immune cells; pharmaceutical compositions and kits containing such polypeptides and polypeptide complexes; and methods of using such polypeptides and polypeptide complexes.

26 Claims, 100 Drawing Sheets

Specification includes a Sequence Listing.

Related U.S. Application Data filed on Dec. 17, 2021, provisional application No. 63/249,833, filed on Sep. 29, 2021, provisional application No. 63/249,919, filed on Sep. 29, 2021, provisional application No. 63/249,722, filed on Sep. 29, 2021, provisional application No. 63/249,794, filed on Sep. 29, 2021.

(51) Int. Cl.

| | |
|---|---|
| *C07K 16/1275* | (2026.01) |
| *C07K 16/28* | (2006.01) |
| *C07K 16/30* | (2006.01) |
| *C07K 19/00* | (2006.01) |

(56) References Cited

U.S. PATENT DOCUMENTS

| | | | |
|---|---|---|---|
| 8,546,543 | B2 | 10/2013 | Lazar |
| 9,221,917 | B2 * | 12/2015 | Baurin ............... C07K 16/2809 |
| 9,315,578 | B2 | 4/2016 | Kumagai et al. |
| 9,315,584 | B2 | 4/2016 | Kumagai et al. |
| 9,382,329 | B2 | 7/2016 | Chang et al. |
| 10,118,970 | B2 | 11/2018 | Fuh et al. |
| 10,131,713 | B2 | 11/2018 | Johnson et al. |
| 10,633,440 | B2 | 4/2020 | Bonvini et al. |
| 10,865,248 | B2 | 12/2020 | Lazar et al. |
| 10,882,922 | B2 | 1/2021 | Yang et al. |
| 11,046,767 | B2 | 6/2021 | Roobrouck et al. |
| 11,149,094 | B2 | 10/2021 | Chiu et al. |
| 11,180,558 | B2 | 11/2021 | Ross et al. |
| 11,186,649 | B2 | 11/2021 | Wu et al. |
| 2005/0079170 | A1 | 4/2005 | Le Gall et al. |
| 2009/0202532 | A1 | 8/2009 | Kumagai et al. |
| 2010/0015133 | A1 | 1/2010 | Igawa et al. |
| 2012/0095191 | A1 | 4/2012 | Kumagai et al. |
| 2014/0322236 | A1 | 10/2014 | Chambers et al. |
| 2015/0079088 | A1 | 3/2015 | Lowman et al. |
| 2015/0225484 | A1 | 8/2015 | Little et al. |
| 2016/0002357 | A1 | 1/2016 | May et al. |
| 2016/0060330 | A1 | 3/2016 | Presta |
| 2016/0194399 | A1 | 7/2016 | Irving et al. |
| 2017/0129962 | A1 | 5/2017 | Regula et al. |
| 2017/0247476 | A1 | 8/2017 | Yan et al. |
| 2018/0155450 | A1 | 6/2018 | Baurin et al. |
| 2018/0230225 | A1 | 8/2018 | Fan et al. |
| 2018/0250322 | A1 | 9/2018 | Devi et al. |
| 2019/0040155 | A1 | 2/2019 | Ellwanger et al. |
| 2019/0169295 | A1 | 6/2019 | Kufer et al. |
| 2020/0040075 | A1 | 2/2020 | Michaels et al. |
| 2020/0071397 | A1 | 3/2020 | Dipersio et al. |
| 2020/0071405 | A1 | 3/2020 | Xiao et al. |
| 2020/0140552 | A1 | 5/2020 | Wu et al. |
| 2020/0330587 | A1 | 10/2020 | Kanekiyo et al. |
| 2020/0399369 | A1 | 12/2020 | Asokan et al. |
| 2020/0405833 | A1 | 12/2020 | Kluge et al. |
| 2021/0002376 | A1 | 1/2021 | Seifert et al. |
| 2021/0061925 | A1 | 3/2021 | Yang et al. |
| 2021/0137977 | A1 | 5/2021 | Chaudhary |
| 2022/0041717 | A1 | 2/2022 | Ross et al. |
| 2023/0203199 | A1 | 6/2023 | Wei et al. |
| 2023/0235092 | A1 | 7/2023 | Wei et al. |
| 2024/0034808 | A1 | 2/2024 | Kamp et al. |
| 2024/0059798 | A1 | 2/2024 | Xu et al. |
| 2024/0109955 | A1 | 4/2024 | Li et al. |

FOREIGN PATENT DOCUMENTS

| | | | |
|---|---|---|---|
| EP | 3156417 | A1 | 4/2017 |
| EP | 2158221 | B1 | 8/2018 |
| EP | 3049440 | B1 | 3/2020 |
| EP | 3177646 | B1 | 10/2020 |
| EP | 3164159 | B1 | 12/2020 |
| EP | 3310811 | B1 | 6/2021 |
| EP | 3365366 | B1 | 7/2021 |
| EP | 3699194 | B1 | 7/2022 | |
| WO | WO-9850431 | A2 | 11/1998 | |
| WO | WO-2007108152 | A1 | 9/2007 | |
| WO | WO-2008157379 | A2 | 12/2008 | |
| WO | WO-2013138400 | A1 | 9/2013 | |
| WO | WO-2015105926 | A1 * | 7/2015 | ............ C07K 16/00 |
| WO | WO-2015173756 | A2 | 11/2015 | |
| WO | WO-2017074878 | A1 | 5/2017 | |
| WO | WO-2017180913 | A2 | 10/2017 | |
| WO | WO-2018/075564 | A1 | 4/2018 | |
| WO | WO-2019195314 | A2 | 10/2019 | |
| WO | WO-2019198051 | A2 | 10/2019 | |
| WO | WO-2019231920 | A1 | 12/2019 | |
| WO | WO-2020/082045 | A1 | 4/2020 | |
| WO | WO-2020088631 | A1 | 5/2020 | |
| WO | WO-2020210386 | A1 | 10/2020 | |
| WO | WO-2020210392 | A1 | 10/2020 | |
| WO | WO-2020229553 | A1 | 11/2020 | |
| WO | WO-2021058807 | A1 | 4/2021 | |
| WO | WO-2021089748 | A2 | 5/2021 | |
| WO | WO-2023/056315 | A1 | 4/2023 | |
| WO | WO-2024/007013 | A2 | 1/2024 | |

OTHER PUBLICATIONS

Rudikoff, S et. al. "Single amino acid substitution altering antigen-binding specificity", 1982, Proceedings of the National Academy of Sciences USA, 79, 1979-1983. (Year: 1982).*

Houdebine, LM, "Production of pharmaceutical proteins by transgenic animals", 2009, Comparative Immunology, Microbiology, and Infectious Diseases, 32, 107-121. (Year: 2009).*

Wall, RJ, "Transenic Livestock: Progress and Prospects for the Future", 1996, Theriogenology, 45, 57-68. (Year: 1996).*

Kappel, CA et. al. "Regulating gene expression in transgenic animals", 1992, Current Opinion in Biotechnology, 3, 548-553. (Year: 1992).*

Asano, R., et al., "Rearranging the domain order of a diabody-based IgG-like bispecific antibody enhances its antitumor activity and improves its degradation resistance and pharmacokinetics," mAbs 6(5):1243-1254, Taylor & Francis, United States (Sep.-Oct. 2014).

Fellermeier, S., et al., "Advancing targeted co-stimulation with antibody-fusion proteins by introducing TNF superfamily members in a single-chain format," Oncoimmunology 5(11):e1238540, Taylor & Francis, United States (Sep. 2016).

Onuoha, S. C., et al., "Rational design of antirheumatic prodrugs specific for sites of inflammation," Arthritis & Rheumatology 67(10):2661-2672, Wiley, United States (Oct. 2015).

Pai, C. S., et al., "Tumor-conditional anti-CTLA4 uncouples anti-tumor efficacy from immunotherapy-related toxicity," The Journal of Clinical Investigation 129(1):349-363, American Society for Clinical Investigation, United States (Jan. 2019).

Roskopf, C. C., et al., "T cell-recruiting triplebody 19-3-19 mediates serial lysis of malignant B-lymphoid cells by a single T cell," Oncotarget 5(15):6466-6483, Impact Journals, United States (Aug. 2014).

Schubert, I., et al., "A single-chain triplebody with specificity for CD19 and CD33 mediates effective lysis of mixed lineage leukemia cells by dual targeting," mAbs 3(1):21-30, Taylor & Francis, United States (Jan.-Feb. 2011).

Schubert, I., et al., "A recombinant triplebody with specificity for CD19 and HLA-DR mediates preferential binding to antigen double-positive cells by dual-targeting," mAbs 4(1):45-56, Taylor & Francis, United States (Jan.-Feb. 2012).

Schubert, I., et al., "A dual-targeting triplebody mediates preferential redirected lysis of antigen double-positive over single-positive leukemic cells," mAbs 6(1):286-296, Taylor & Francis, United States (Jan.-Feb. 2014).

Steinmetz, A., et al., "CODV-Ig, a universal bispecific tetravalent and multifunctional immunoglobulin format for medical applications," mAbs 8(5):867-878, Taylor & Francis, United States (Jul. 2016).

Thiemann, M., et al., "A Single-Chain-Based Hexavalent CD27 Agonist Enhances T Cell Activation and Induces Anti-Tumor Immunity," Frontiers in Oncology 8(387):1-17, Frontiers Research Foundation, Switzerland (Sep. 2018).

(56) References Cited

OTHER PUBLICATIONS

Co-pending U.S. Appl. No. 17/936,041, inventor Wei, R. R., et al., filed Sep. 28, 2022 (Not yet Published).

Co-pending U.S. Appl. No. 17/936,044, inventors Wei, R. R., et al.., filed Sep. 28, 2022 (Not yet Published).

Asokan, M., et al., "Bispecific Antibodies Targeting Different Epitopes on the HIV-1 Envelope Exhibit Broad and Potent Neutralization," J. Virol., 89(24):12501-12512, American Society for Microbiology, Washington, D.C. (Dec. 2015).

Fry, T.J., et al., "CD22-CAR T Cells Induce Remissions in CD19-CAR Naïve and Resistant B-ALL," Nat. Med., 24(1):20-28, Nature Portfolio, Berlin, Germany (Jan. 2018).

Padte, N.N., et al., "Engineering multi-specific antibodies against HIV-1," Retrovirol., 15(1):60, BioMed Central, London, United Kingdom (Aug. 2018).

Steinhardt, J.J., et al., "Rational design of a trispecific antibody targeting the HIV-1 Env with elevated anti-viral activity," Nat. Commun., 9(877):1-12, Nature Portfolio, Berlin, Germany (Feb. 2018).

Xu, L., et al., "Trispecific broadly neutralizing HIV antibodies mediate potent SHIV protection in macaques," Science, 358(6359)85-90, American Association for the Advancement of Science, Washington, D.C. (Oct. 2017).

Zhang, Y., et al., "Bispecific CD19/22 CAR T Cell Therapy in Patients With Relapsed or Refractory B Cell Non-Hodgkin Lymphoma," Front. Oncol., 11:664421, Frontiers Media SA, Lausanne, Switzerland (May 2021).

Third Party Observation for Int'l Application No. PCT/US2002/077202, Int'l Filing Date: Sep. 28, 2022, Date of Submission: Jan. 29, 2024, 19 pages.

* cited by examiner

FIG. 12F 1. aCD28aCD3L1-His Non-reducing- SEQ ID 310
2. aCD19aCD38L1-His Non-reducing- SEQ ID 311
3. aCD28aCD3L1-His Reducing- SEQ ID 310
4. aCD19aCD38L1-His Reducing- SEQ ID 311

SEQ ID: 311

1. aCD3aCD28L1LALAPA seq 314
2. aCD28aCD3L1LALAPA seq 312
3. aCD3aCD28L2LALAPA seq 315
4. aCD28aCD3L2LALAPA seq 313

FIG. 23

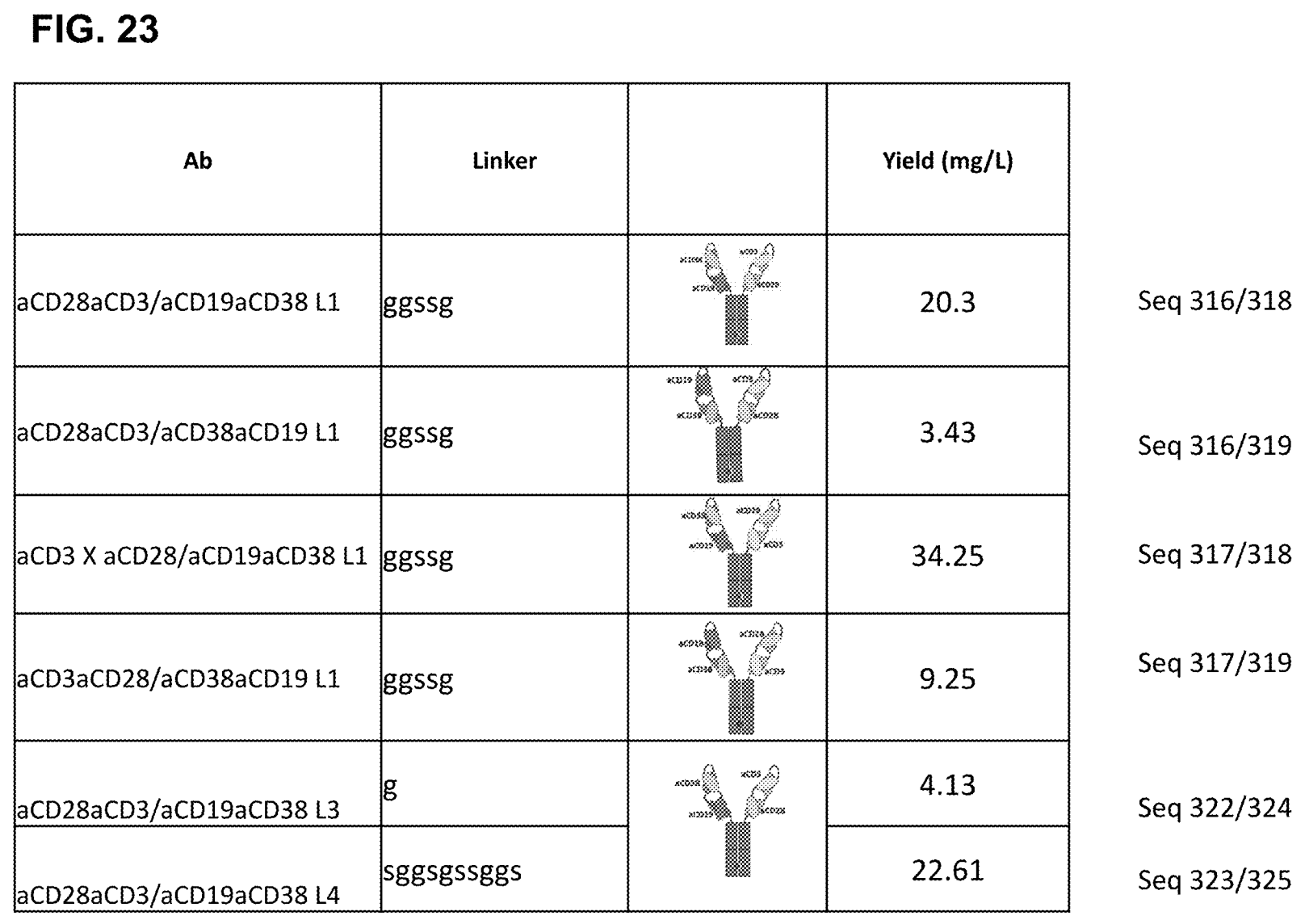

| Ab | Linker | | Yield (mg/L) | |
|---|---|---|---|---|
| aCD28aCD3/aCD19aCD38 L1 | ggssg | | 20.3 | Seq 316/318 |
| aCD28aCD3/aCD38aCD19 L1 | ggssg | | 3.43 | Seq 316/319 |
| aCD3 X aCD28/aCD19aCD38 L1 | ggssg | | 34.25 | Seq 317/318 |
| aCD3aCD28/aCD38aCD19 L1 | ggssg | | 9.25 | Seq 317/319 |
| aCD28aCD3/aCD19aCD38 L3 | g | | 4.13 | Seq 322/324 |
| aCD28aCD3/aCD19aCD38 L4 | sggsgssggs | | 22.61 | Seq 323/325 |

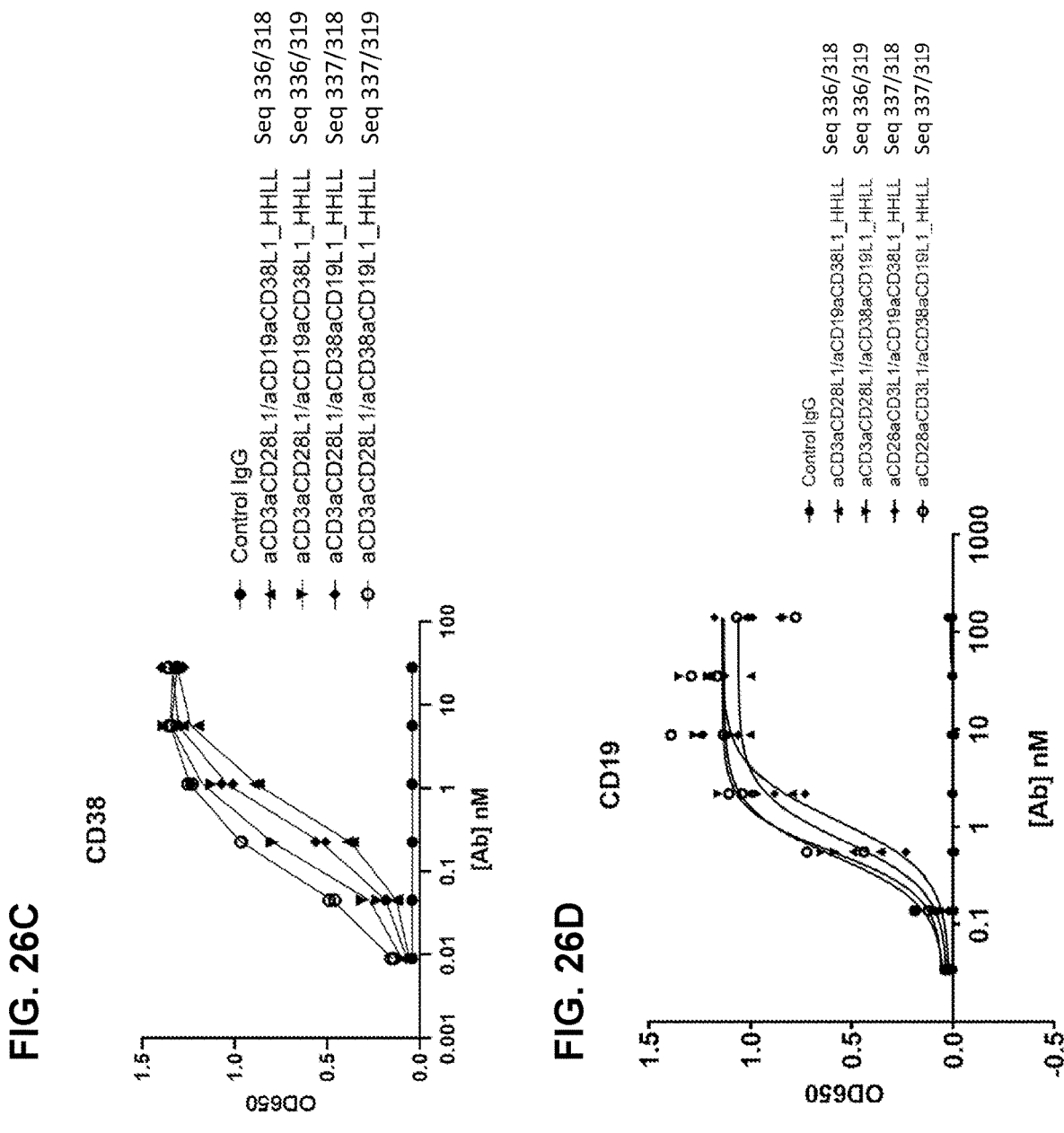

Donor 3

10:1 ET ratio

Sample ID: MX853

FIG. 46A

HIVgp120ΔCD4bs His

RSC3 His

HIVgp140ΔCD4bs His

HIVgp140ΔCD4bs His

HIVgp140ΔCD4bs His

1

ANTIGEN BINDING POLYPEPTIDES, ANTIGEN BINDING POLYPEPTIDE COMPLEXES AND METHODS OF USE THEREOF

CROSS REFERENCE TO RELATED APPLICATIONS

This application claims the priority benefit of U.S. Provisional Application No. 63/249,722, filed Sep. 29, 2021; U.S. Provisional Application No. 63/249,794, filed Sep. 29, 2021; U.S. Provisional Application No. 63/249,833, filed Sep. 29, 2021; U.S. Provisional Application No. 63/249,919, filed Sep. 29, 2021; U.S. Provisional Application No. 63/291,305, filed Dec. 17, 2021; and U.S. Provisional Application No. 63/292,382, filed Dec. 21, 2021; which are all incorporated herein by reference in their entireties.

REFERENCE TO SEQUENCE LISTING SUBMITTED ELECTRONICALLY

The content of the electronically submitted sequence listing (Name: 4850_0050001_Seqlisting_ST26; Size: 1,215,029 bytes; and Date of Creation: Sep. 26, 2022) is herein incorporated by reference in its entirety.

FIELD

The present disclosure relates to antigen binding polypeptides and antigen binding polypeptide complexes (e.g., antibodies and antigen binding fragments thereof) having certain structural features. The present disclosure also relates to polynucleotides and vectors encoding such polypeptides and polypeptide complexes; host cells, chimeric antigen receptors (CARs), immune cells, pharmaceutical compositions and kits containing such polypeptides and polypeptide complexes; and methods of using such polypeptides and polypeptide complexes.

BACKGROUND

Immunotherapy is the treatment of disease by activating or suppressing the immune system. In recent years, immunotherapy has become of great interest to researchers and clinicians, particularly in its promise to treat cancer and infectious disease. Therapeutic antibodies are an important type of immunotherapy. Therapeutic antibodies can be monospecific, meaning that they have specificity to one antigen or epitope. Therapeutic antibodies have also been engineered to have specificity for two different antigens or epitopes (i.e., bispecific antibodies) or for multiple different antigens or epitopes (trispecific antibodies, tetraspecific antibodies, etc.). In addition, monospecific, bispecific and multispecific antibodies have been combined to form multi-targeting strategies to treat complex human diseases, such as cancer and infectious disease.

However, the development of therapeutic antibodies can be challenging, especially manufacturing and late stage development. For example, the production of bispecific or multispecific antibodies often requires multiple genes or plasmids for cell line development. These multiple genes or plasmids must be delivered into the same cell to make the correct molecules. Furthermore, bispecific and multispecific antibodies can have mispairing between the heavy and light chains, which can reduce product yield, increase cell line colony screen workload, and create product heterogeneity.

There is a need for multispecific and multifunctional antigen binding polypeptides and antigen binding polypeptide complexes that can bind to specific combinations of target molecules for selectivity or breadth/neutralization, bring together two or more cell types, bring together targets and deliver activation signals, modify the disease microenvironment, and enhance avidity of binding for improved potency. The present invention meets this unmet need.

In addition, human immunodeficiency virus (HIV) poses a major infectious disease burden with immense medical and economic impact around the world. Globally, ~38 million people have been infected with HIV, and more than 30 million individuals have succumbed to acquired immunodeficiency syndrome (AIDS), a chronic condition of weakened immune system caused by HIV infection. "Global Health Sector Strategy On HIV—2016-2021—Towards Ending AIDS," World Health Organization, June 2016. There are two major forms of HIV: HIV-1 and HIV-2. HIV-1 is the more prevalent form worldwide, while HIV-2 is less pathogenic and mostly confined to West Africa.

The major structural proteins of HIV are Gag, Pol and Env. Gag (group specific antigen) is the structural protein for the viral core. Pol is a polyprotein containing the enzymes critical for viral replication: protease (PR), reverse transcriptase (RT), and integrase (IN). Env (envelope) encodes glycoproteins that form the virus's exterior envelope. Env is synthesized as a precursor glycoprotein, gp160, and is then processed into gp120 and gp41. Env interacts with the primary receptor CD4 and a coreceptor (such as chemokine receptor CCR5) to fuse viral and target-cell membranes.

The genetic heterogeneity and glycan shielding of Env have resisted the development of natural immunity to HIV and posed challenges to traditional vaccine development. It has also prompted a search for alternative approaches to HIV prevention, one of the highest priorities in global health.

Despite a significant collection of anti-HIV/AIDS drugs available, HIV patients still face daily challenges in taking multiple medicines with strict regimens. Inevitably, most patients will bear the consequences of emergence of drug-resistant viral variants, and develop other health issues from the toxicities of taking anti-HIV medicines long term, such as cardiovascular disease, kidney disease, diabetes, bone disease, liver disease, cognitive disorders, etc. Alternative treatment options are urgently needed for HIV/AIDS patients.

Broadly neutralizing HIV-1 antibodies (bnAbs) are antibodies that neutralize multiple HIV-1 viral strains. bnAbs target conserved epitopes of the virus, meaning that the targeted epitopes may be more likely to remain even if the virus mutates. As such, bnAbs have been investigated recently for HIV/AIDS treatment and prevention. Human clinical studies have revealed two factors critical for efficacy of bnAbs. First, there is the need to exceed a minimally effective dose, or trough level of circulating bnAbs to prevent infection. Second, there is a need to prevent the emergence of viral escape through resistance mutations.

Early human clinical studies using bnAbs demonstrated the feasibility and safety of this approach with transient reductions of viral load and acceptable tolerability and immunogenicity. Burton et al., Annu Rev. Immunol. 34:635-659 (2016); Mascola et al., Immunol. Rev. 254:225-244 (2013); Wu et al., Science. 329:856-861 (2010). However, resistant HIV strains emerged rapidly following treatment with individual bnAbs in vitro and in vivo. More recently, a phase II clinical trial with the VRC01 bnAb highlighted the importance of maintaining adequate circulating antibody levels to reduce acquisition rates, suggesting that combination antibody therapy which enhances potency and minimizes escape mutations will be required for effective prevention. Corey et al., N. Engl. J. Med. 384:1003-1014 (2021).

Multispecific antibodies address the limitations of bnAbs by providing a single antibody type that recognizes multiple independent binding sites on HIV-1 envelope protein. Xu et al., Science. 358(6359):85-90 (2017). Treatment with multispecific antibodies also ensures that independent binding specificities are maintained with the same pharmacokinetics, while treatment with multiple single-target antibodies results in different antibody half-lives that wane at different rates. Furthermore, multispecific antibodies simplify manufacturing and regulatory processes by using one product for clinical development instead of a combination of multiple products.

Accordingly, multispecific anti-HIV antibodies provide an important technological platform for developing neutralizing antibody-based therapeutics for treating HIV/AIDS, offering a class of medicines with low long-term toxicities and significantly less frequent treatment regimen. Multispecific antibodies also use completely different targets on HIV from the current standard of care HIV/AIDS medicine, complementing to the existing medicines by providing patients alternatives for their disease control and health management. Multispecific antibodies may also offer a meaningful way for HIV prevention in the current absence of an effective HIV vaccine.

In addition, the development of therapeutic antibodies can be challenging, especially manufacturing and late stage development. For example, the production of multispecific antibodies often requires multiple genes or plasmids for cell line development. These multiple genes or plasmids must be delivered into the same cell to make the correct molecules. Furthermore, multispecific antibodies can have mispairing between the heavy and light chains, which can reduce product yield, increase cell line colony screen workload, and create product heterogeneity.

As such, there is a need for multispecific and multifunctional antibodies, antigen binding polypeptides and antigen binding polypeptide complexes that can bind to HIV proteins for selectivity or breadth/neutralization, bring together two or more cell types, bring together targets and deliver activation signals, modify the HIV microenvironment, and enhance avidity of binding for improved potency. The present invention meets this unmet need.

BRIEF SUMMARY

Provided herein is an antigen binding polypeptide having a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; wherein VL1 is a first immunoglobulin light chain variable region; VL2 is a second immunoglobulin light chain variable region; VL3 is a third immunoglobulin light chain variable region; VH1 is a first immunoglobulin heavy chain variable region; VH2 is a second immunoglobulin heavy chain variable region; VH3 is a third immunoglobulin heavy chain variable region; and L1, L2, L3, L4 and L5 are amino acid linkers.

Provided herein is an antigen binding polypeptide complex comprising a first polypeptide and a second polypeptide; wherein the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; wherein the second polypeptide has a structure represented by VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1 is a first immunoglobulin light chain variable region; VL2 is a second immunoglobulin light chain variable region; VL3 is a third immunoglobulin light chain variable region; VL4 is a fourth immunoglobulin light chain variable region; VL5 is a fifth immunoglobulin light chain variable region; VL6 is a sixth immunoglobulin light chain variable region; VH1 is a first immunoglobulin heavy chain variable region; VH2 is a second immunoglobulin heavy chain variable region; VH3 is a third immunoglobulin heavy chain variable region; VH4 is a fourth immunoglobulin heavy chain variable region; VH5 is a fifth immunoglobulin heavy chain variable region; VH6 is a sixth immunoglobulin heavy chain variable region; and L1, L2, L3, L4, L5, L6, L7, L8, L9 and L10 are amino acid linkers.

Provided herein is an antigen binding polypeptide having a structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; VH1-VL2-VL3-VH3-VH2-VL1-Fc; VL1-L1-VL2-L2-VL3-L3-VH3-L4-VH2-L5-VH1-Fc; VL1-L1-VL2-L2-VL3-L3-VH3-L4-VH2-L5-VH1-L6-Fc; VH1-L1-VH2-L2-VH3-L3-VL3-L4-VL2-L5-VL1-Fc; VH1-L1-VH2-L2-VH3-L3-VL3-L4-VL2-L5-VL1-L6-Fc; VL1-L1-VH2-L2-VL3-L3-VH3-L4-VL2-L5-VH1-Fc; VL1-L1-VH2-L2-VL3-L3-VH3-L4-VL2-L5-VH1-L6-Fc; VH1-L1-VL2-L2-VH3-L3-VL3-L4-VH2-L5-VL1-Fc; VH1-L1-VL2-L2-VH3-L3-VL3-L4-VH2-L5-VL1-L6-Fc; VL1-L1-VL2-L2-VH3-L3-VL3-L4-VH2-L5-VH1-Fc; VL1-L1-VL2-L2-VH3-L3-VL3-L4-VH2-L5-VH1-L6-Fc; VH1-L1-VH2-L2-VL3-L3-VH3-L4-VL2-L5-VL1-Fc; VH1-L1-VH2-L2-VL3-L3-VH3-L4-VL2-L5-VL1-L6-Fc; VL1-L1-VH2-L2-VH3-L3-VL3-L4-VH2-L5-VH1-Fc; VL1-L1-VH2-L2-VH3-L3-VL3-L4-VL2-L5-VH1-L6-Fc; VH1-L1-VH2-L2-VL3-L3-VH3-L4-VL2-L5-VL1-Fc; VH1-L1-VH2-L2-VL3-L3-

VH3-L4- VL2-L5-VL1-L6-Fc; VL1-L1-VH2-L2-VH3-L3-
VL3-L4-VL2-L5-VH1-Fc; VL1-L1-VH2-L2-VH3-L3-
VL3-L4-VL2- L5-VH1-L6-Fc; VH1-L1-VL2-L2-VL3-L3-
VH3-L4-VH2-L5-VL1-Fc; or VH1-L1-VL2-L2-VL3-L3-
VH3-L4-VH2-L5-VL1-L6-Fc; wherein VL1 is a first
immunoglobulin light chain variable region; VL2 is a sec-
ond immunoglobulin light chain variable region; VL3 is a
third immunoglobulin light chain variable region; VH1 is a
first immunoglobulin heavy chain variable region; VH2 is a
second immunoglobulin heavy chain variable region; VH3
is a third immunoglobulin heavy chain variable region; Fc is
a region comprising an immunoglobulin heavy chain con-
stant region 2 (CH2), an immunoglobulin heavy chain
constant region 3 (CH3), and optionally, an immunoglobulin
hinge; and L1, L2, L3, L4, L5 and L6 are amino acid linkers.

Provided herein is an antigen binding polypeptide having
a structure represented by VL1-VL2-VL3-VH3-VH2-VH1-
Fc-Fc; VH1-VH2-VH3-VL3-VL2-VL1-Fc-Fc; VL1-VH2-
VL3-VH3-VL2-VH1-Fc-Fc; VH1-VL2-VH3-VL3-VH2-
VL1-Fc-Fc; VL1-VL2-VH3-VL3-VH2-VH1-Fc-Fc; VH1-
VH2-VL3-VH3-VL2-VL1-Fc-Fc; VL1-VH2-VH3-VL3-
VL2-VH1-Fc-Fc; VH1-VL2-VL3-VH3-VH2-VL1-Fc-Fc;
VL1-L1-VL2-L2-VL3-L3-VH3-L4-VH2-L5-VH1-Fc-Fc;
VL1-L1-VL2-L2-VL3-L3-VH3-L4-VH2-L5-VH1-L6-Fc-
Fc; VL1-L1-VL2-L2-VL3-L3-VH3-L4-VH2-L5-VH1-L6-
Fc-L7-Fc; VH1-L1-VH2-L2-VH3-L3-VL3-L4-VL2-L5-
VL1-Fc-Fc; VH1-L1-VH2-L2-VH3-L3-VL3-L4-VL2-L5-
VL1-L6-Fc-Fc; VH1-L1-VH2-L2-VH3-L3-VL3-L4-VL2-
L5-VL1-L6-Fc-L7-Fc; VL1-L1-VH2-L2-VL3-L3-VH3-L4-
VL2-L5-VH1-Fc-Fc; VL1-L1-VH2-L2-VL3-L3-VH3-L4-
VL2-L5-VH1-L6-Fc-Fc; VL1-L1-VH2-L2-VL3-L3-VH3-
L4-VL2-L5-VH1-L6-Fc-L7-Fc; VH1-L1-VL2-L2-VH3-
L3-VL3-L4-VH2-L5-VL1-Fc-Fc; VH1-L1-VL2-L2-VH3-
L3-VL3-L4-VH2-L5-VL1-L6-Fc-Fc; VH1-L1-VL2-L2-
VH3-L3-VL3-L4-VH2-L5-VL1-L6-Fc-L7-Fc; VL1-L1-
VL2-L2-VH3-L3-VL3-L4-VH2-L5-VH1-Fc-Fc; VL1-L1-
VL2-L2-VH3-L3-VL3-L4-VH2-L5-VH1-L6-Fc-Fc; VL1-
L1-VL2-L2-VH3-L3-VL3-L4-VH2-L5-VH1-L6-Fc-L7-Fc;
VH1-L1-VH2-L2-VL3-L3-VH3-L4-VL2-L5-VL1-Fc-Fc;
VH1-L1-VH2-L2-VL3-L3-VH3-L4-VL2-L5-VL1-L6-Fc-
Fc; VH1-L1-VH2-L2-VL3-L3-VH3-L4-VL2-L5-VL1-L6-
Fc-L7-Fc; L1-L1-VH2-L2-VH3-L3-VL3-L4-VL2-L5-
VH1-Fc-Fc; VL1-L1-VH2-L2-VH3-L3-VL3-L4-VL2-
VH1-L6-Fc-Fc; VL1-L1-VH2-L2-VH3-L3-VL3-L4-VL2-
L5-VH1-L6-Fc-L7-Fc; VH1-L1-VL2-L2-VL3-L3-VH3-
L4-VH2-L5-VL1-Fc-Fc; VH1-L1-VL2-L2-VL3-L3-VH3-
L4-VH2-L5-VL1-L6-Fc-Fc; or VH1-L1-VL2-L2-VL3-L3-
VH3-L4-VH2-L5-VL1-L6- Fc-L7-Fc; wherein VL1 is a first
immunoglobulin light chain variable region; VL2 is a sec-
ond immunoglobulin light chain variable region; VL3 is a
third immunoglobulin light chain variable region; VH1 is a
first immunoglobulin heavy chain variable region; VH2 is a
second immunoglobulin heavy chain variable region; VH3
is a third immunoglobulin heavy chain variable region; Fc is
a region comprising an immunoglobulin heavy chain con-
stant region 2 (CH2), an immunoglobulin heavy chain
constant region 3 (CH3), and optionally, an immunoglobulin
hinge; and L1, L2, L3, L4, L5, L6 and L7 are amino acid
linkers.

Provided herein is an antigen binding polypeptide com-
plex comprising a first polypeptide and a second polypep-
tide; wherein the first polypeptide has a structure represented
by VL1-VL2-VL3-VH3-VH2-VH1-Fc; VH1-VH2-VH3-
VL3-VL2-VL1-Fc; VL1-VH2-VH3-VL3-VL2-VH1-Fc;
VH1-VL2-VH3-VL3-VH2-VL1-Fc; VL1-VL2-VH3-VL3-
VH2-VH1-Fc; VH1-VH2-VL3-VH3-VL2-VL1-Fc; VL1-
VH2-VH3-VL3-VL2-VH1-Fc; VH1-VL2-VL3-VH3-VH2-

VL1-Fc; VL1-L1-VL2-L2-VL3-L3-VH3-L4-VH2-L5-
VH1-Fc; VL1-L1-VL2-L2-VL3-L3-VH3-L4-VH2-L5-
VH1-L6-Fc; VH1-L1-VH2-L2-VH3-L3-VL3-L4-VL2-L5-
VL1-Fc; VH1-L1-VH2-L2-VH3-L3-VL3-L4-VL2-L5-
VL1- L6-Fc; VL1-L1-VH2-L2-VL3-L3-VH3-L4-VL2-L5-
VH1-Fc; VL1-L1-VH2-L2-VL3-L3-VH3-L4-VL2-L5-
VH1-L6-Fc; VH1-L1-VL2-L2-VH3-L3-VL3-L4-VH2-L5-
VL1-Fc; VH1-L1-VL2-L2-VH3-L3-VL3-L4-VH2-L5-
VL1-L6-Fc; VL1- L1-VL2-L2-VH3-L3-VL3-L4-VH2-L5-
VH1-Fc; VL1-L1-VL2-L2-VH3-L3-VL3-L4-VH2-L5-
VH1-L6-Fc; VH1-L1- VH2-L2-VL3-L3-VH3-L4-VL2-L5-
VL1-Fc; VH1-L1-VH2-L2-VL3-L3-VH3-L4-VL2-L5-
VL1-L6-Fc; VL1-L1-VH2- L2-VL3-L3-VL3-L4-VL2-L5-
VH1-Fc; VL1-L1-VH2-L2-VH3-L3-VL3-L4-VL2-L5-
VH1-L6-Fc; VH1-L1-VL2-L2- VL3-L3-VH3-L4-VH2-L5-
VL1-Fc; or VH1-L1-VL2-L2-VL3-L3-VH3-L4-VH2-L5-
VL1-L6-Fc; wherein the second polypeptide has a structure
represented by Fc; VL4-VH4-Fc; VH4-VL4-Fc; VL4-L7-
VH4-Fc; VH4-L7-VL4-Fc; VL4-L7-VH4-L8-Fc; VH4-L7-
VL4-L8-Fc; VL4-CL-VH4-CH1-Fc; VH4-CL-VL4-CH1-
Fc; VL4-CH1-VH4-CL-Fc; VH4-CH1-VL4-CL-Fc; VL4-
L7-CL-L8-VH4-L9-CH1-Fc; VL4-L7-CL-L8-VH4-L9-
CH1-L10-Fc; VH4-L7-CL-L8-VL4-L9-CH1-Fc; VH4-L7-
CL-L8-VL4-L9-CH1-L10-Fc; VL4-L7-CH1-L8-VH4-L9-
CL-Fc; VL4-L7-CH1-L8-VH4-L9-CL-L10-Fc; VH4-L7-
CH1-L8-VL4-L9-CL-Fc; VH4-L7-CH1-L8-VL4-L9-CL-
L10-Fc; VL4-VL5-VH5-VH4-Fc; VH4-VH5-VL5-VL4-Fc;
VL4-L7-VL5-L8-VH5-L9-VH4-Fc; VH4-L7-VH5-L8-
VL5-L9-VL4-Fc; VL4-L7-VL5-L8-VH5-L9-VH4-L10-Fc;
VH4-L7-VH5-L8-VL5-L9-VL4-L10-Fc; VL4-VL5-VL6-
VH6-VH5-VH4-Fc; VH4-VH5-VH6-VL6-VL5-VL4-Fc;
VL4-VH5-VL6-VH6-VL5-VH4-Fc; VH4-VL5-VH6-VL6-
VH5-VL4-Fc; VL4-VL5-VH6-VL6-VH5-VH4-Fc; VH4-
VH5-VL6-VH6-VL5-VL4-Fc; VL4-VH5-VH6-VL6-VL5-
VH4-Fc; VH4-VL5-VL6-VH6-VH5-VL4-Fc; VL4-L7-
VL5-L8-VL6-L9-VH6-L10-VH5-L11-VH4-Fc; VH4-L7-
VH5-L8-VH6-L9-VL6-L10-VL5-L11-VL4-Fc; VL4-L7-
VH5-L8-VL6-L9-VH6-L10-VL5-L11-VH4-Fc; VH4-L7-
VL5-L8-VH6-L9-VL6-L10-VH5-L11-VL4-Fc; VL4-L7-
VL5-L8-VH6-L9-VL6-L10-VH5-L11-VH4-Fc; VH4-L7-
VH5-L8-VL6-L9-VH6-L10-VL5-L11-VL4-Fc; VL4-L7-
VH5-L8-VH6-L9-VL6-L10-VL5-L11-VH4-Fc; VH4-L7-
VL5-L8-VL6-L9-VH6-L10-VH5-L11-VL4-Fc; VL4-L7-
VL5-L8-VL6-L9-VH6-L10-VH5-L11-VH4-L12-Fc; VH4-
L7-VH5-L8-VH6-L9-VL6-L10-VL5-L11-VL4-L12-Fc;
VL4-L7-VH5-L8-VL6-L9-VH6-L10-VL5-L11-VH4-L12-
Fc; VH4-L7-VL5-L8-VH6-L9-VL6-L10-VH5-L11-VL4-
L12-Fc; VL4-L7-VL5-L8-VH6-L9-VL6-L10-VH5-L11-
VH4-L12-Fc; VH4-L7-VH5-L8-VL6-L9-VH6-L10-VL5-
L11-VL4-L12-Fc; VL4-L7-VH5-L8-VH6-L9-VL6-L10-
VL5-L11-VH4-L12-Fc; or VH4-L7-VL5-L8-VL6-L9-VH6-
L10-VH5-L11-VL4-L12-Fc; wherein VL1 is a first
immunoglobulin light chain variable region; VL2 is a sec-
ond immunoglobulin light chain variable region; VL3 is a
third immunoglobulin light chain variable region; VL4 is a
fourth immunoglobulin light chain variable region; VL5 is a
fifth immunoglobulin light chain variable region; VL6 is a
sixth immunoglobulin light chain variable region; VH1 is a
first immunoglobulin heavy chain variable region; VH2 is a
second immunoglobulin heavy chain variable region; VH3
is a third immunoglobulin heavy chain variable region; VH4
is a fourth immunoglobulin heavy chain variable region;
VH5 is a fifth immunoglobulin heavy chain variable region;
VH6 is a sixth immunoglobulin heavy chain variable region;
Fc is a region comprising an immunoglobulin heavy chain
constant region 2 (CH2), an immunoglobulin heavy chain
constant region 3 (CH3), and optionally, an immunoglobulin hinge; CH1 is a heavy chain constant region 1; CL is a light chain constant region; and L1, L2, L3, L4, L5, L6, L7, L8, L9, L10, L11 and L12 are amino acid linkers.

Provided herein is an antigen binding polypeptide having a structure represented by VL1-VL2-VL3-VH3-VH2-VH1-CH1-CL; VL1-VL2-VL3-VH3-VH2-VH1-CL-CH1; VH1-VH2-VH3-VL3-VL2-VL1-CH1-CL; VH1-VH2-VH3-VL3-VL2-VL1-CL-CH1; VL1-VH2-VL3-VH3-VL2-VH1-CH1-CL; VL1-VH2-VL3-VH3-VL2-VH1-CL-CH1; VH1-VL2-VH3-VL3-VH2-VL1-CH1-CL; VH1-VL2-VH3-VL3-VH2-VL1-CL-CH1; VL1-VL2-VH3-VL3-VH2-VH1-CH1-CL; VL1-VL2-VH3-VL3-VH2-VH1-CL-CH1; VH1-VH2-VL3-VH3-VL2-VL1-CH1-CL; VH1-VH2-VL3-VH3-VL2-VL1-CL-CH1; VL1-VH2-VH3-VL3-VL2-VH1-CH1-CL; VL1-VH2-VH3-VL3-VL2-VH1-CL-CH1; VH1-VL2-VL3-VH3-VH2-VL1-CH1-CL; VH1-VL2-VL3-VH3-VH2-VL1-CL-CH1; VL1-L1-VL2-L2-VL3-L3-VH3-L4-VH2-L5-VH1-CH1-CL; VL1-L1-VL2-L2-VL3-L3-VH3-L4-VH2-L5-VH1-L6-CH1-CL; VL1-L1-VL2-L2-VL3-L3-VH3-L4-VH2-L5-VH1-CL-CH1; VL1-L1-VL2-L2-VL3-L3-VH3-L4-VH2-L5-VH1-L6-CL-CH1; VL1-L1-VL2-L2-VL3-L3-VH3-L4-VH2-L5-VH1-L6-CL-L7-CH1; VH1-L1-VH2-L2-VH3-L3-VL3-L4-VL2-L5-VL1-CH1-CL; VH1-L1-VH2-L2-VH3-L3-VL3-L4-VL2-L5-VL1-L6-CH1-CL; VH1-L1-VH2-L2-VH3-L3-VL3-L4-VL2-L5-VL1-L6-CH1-L7-CL; VH1-L1-VH2-L2-VH3-L3-VL3-L4-VL2-L5-VL1-CL-CH1; VH1-L1-VH2-L2-VH3-L3-VL3-L4-VL2-L5-VL1- L6-CL-CH1; VL1-L1-VH2-L2-VL3-L3-VH3-L4-VL2-L5-VH1-CH1-CL; VL1-L1-VH2-L2-VL3-L3-VH3-L4-VL2-L5-VH1-L6-CH1-CL; VL1-L1-VH2-L2-VL3-L3-VH3-L4-VL2-L5-VH1-L6-CH1-L7-CL; VL1-L1-VH2-L2-VL3-L3- VH3-L4-VL2-L5-VH1-CL-CH1; VL1-L1-VH2-L2-VL3-L3-VH3-L4-VL2-L5-VH1-L6-CL-CH1; VH1-L1-VL2-L2-VH3- L3-VL3-L4-VH2-L5-VL1-CH1-CL; VH1-L1-VL2-L2-VH3-L3-VL3-L4-VH2-L5-VL1-L6-CH1-CL; VH1-L1-VL2-L2-VH3-L3-VL3-L4-VH2-L5-VL1-L6-CH1-L7-CL; VH1-L1-VL2-L2-VH3-L3-VL3-L4-VH2-L5-VL1-CL-CH1; VH1- L1-VL2-L2-VH3-L3-VL3-L4-VH2-L5-VL1-L6-CL-CH1; VH1-L1-VL2-L2-VH3-L3-VL3-L4-VH2-L5-VL1-L6-CL- L7-CH1; VL1-L1-VL2-L2-VH3-L3-VL3-L4-VH2-L5-VH1-CH1-CL; VL1-L1-VL2-L2-VH3-L3-VL3-L4-VH2-L5- VH1-L6-CH1-CL; VL1-L1-VL2-L2-VH3-L3-VL3-L4-VH2-L5-VH1-L6-CH1-L7-CL; VL1-L1-VL2-L2-VH3-L3-VL3-L4-VH2-L5-VH1-CL-CH1; VL1-L1-VL2-L2-VL3-L3-VH3-L4-VL2-L5-VH1-L6-CL-CH1; VH1-L1-VH2-L2-VL3-L3-VH3-L4-VL2-L5-VL1-CH1-CL; VH1-L1-VH2-L2-VL3-L3-VH3-L4-VL2-L5-VL1-L6-CH1-CL; VH1-L1-VH2-L2-VL3-L3-VH3-L4-VL2-L5-VL1-L6-CH1-L7-CL; VH1-L1-VH2-L2-VL3-L3-VH3-L4-VL2-L5-VL1-CL-CH1; VH1-L1-VH2-L2-VL3-L3-VH3-L4-VL2-L5-VL1-L6-CL-CH1; VH1-L1-VH2-L2-VL3-L3-VH3-L4-VL2-L5-VL1-L6-CL-L7-CH1; VL1-L1-VH2-L2-VL3-L3-VH3-L4-VH2-L5-VL1-CH1-CL; VL1-L1-VH2- L2-VL3-L3-VH3-L4-VH2-L5-VL1-L6-CH1-CL; VL1-L1-VH2-L2-VH3-L3-VL3-L4-VL2- L5-VH1-L6-CH1-CL; VL1-L1-VH2-L2-VH3-L3-VL3-L4-VL2-L5-VH1-CH1-CL; VL1-L1-VH2-L2-VH3-L3-VL3-L4-VL2-L5-VH1-L6-CH1-L7-CL; VL1-L1-VH2-L2-VH3- L3-VL3-L4-VL2-L5-VH1-CL-CH1; VL1-L1-VH2-L2-VH3-L3-VL3-L4-VL2-L5-VH1-L6-CL-CH1; VL1-L1-VH2-L2-VH3- L3-VL3-L4-VL2-L5-VH1-L6-CL-L7-CH1; VH1-L1-VL2-L2-VL3-L3-VH3-L4-VH2-L5-VL1-CH1-CL; VH1-L1-VL2- L2-VL3-L3-VH3-L4-VH2-L5-VL1-L6-CH1-CL; VH1-L1-VL2-L2-VL3-L3-VH3-L4-VH2-L5-VL1-L6-CH1-L7-CL; VH1-L1-VL2-L2-VL3-L3-VH3-L4-VH2-L5-VL1-L6-CL- CH1; or VH1-L1-VL2-L2-VL3-L3-VH3-L4-VH2-L5-VL1-L6-

CL-L7-CH1; wherein VL1 is a first immuno globulin light chain variable region; VL2 is a second immunoglobulin light chain variable region; VL3 is a third immunoglobulin light chain variable region; VH1 is a first immunoglobulin heavy chain variable region; VH2 is a second immunoglobulin heavy chain variable region; VH3 is a third immunoglobulin heavy chain variable region; CH1 is a heavy chain constant region 1; CL is a light chain constant region; and L1, L2, L3, L4, L5, L6 and L7 are amino acid linkers.

Provided herein is an antigen binding polypeptide complex comprising a first polypeptide and a second polypeptide; wherein the first polypeptide has a structure represented by VL1-VL2-VL3-VH3-VH2-VH1-CH1; VL1-VL2-VL3-VH3-VH2-VH1-CL; VL1-VL2-VL3-VH3-VH2-VH1-CH1-CL; VL1-VL2-VL3-VH3-VH2-VH1-CL-CH1; VH1-VH2-VH3-VL3-VL2-VL1-CH1; VH1-VH2-VH3-VL3-VL2-VL1-CL; VH1-VH2-VH3-VL3-VL2-VL1-CH1-CL; VH1-VH2-VH3-VL3-VL2-VL1-CL-CH1; VL1-VH2-VL3-VH3-VL2-VH1-CH1; VL1-VH2-VL3-VH3-VL2-VH1-CL; VL1-VH2-VL3-VH3-VL2-VH1-CH1-CL; VL1-VH2-VL3-VH3-VL2-VH1-CL-CH1; VH1-VL2-VH3-VL3-VH2-VL1-CH1; VH1-VL2-VH3-VL3-VH2-VL1-CL; VH1-VL2-VH3-VL3-VH2-VL1-CH1-CL; VH1-VL2-VH3-VL3-VH2-VL1-CL-CH1; VL1-VL2-VH3-VL3-VH2-VH1-CH1; VL1-VL2-VH3-VL3-VH2-VH1-CL; VL1-VL2-VH3-VL3-VH2-VH1-CH1-CL; VL1-VL2-VH3-VL3-VH2-VH1-CL-CH1; VH1-VH2-VL3-VH3-VL2-VL1-CH1; VH1-VH2-VL3-VH3-VL2-VL1-CL; VH1-VH2-VL3-VH3-VL2-VL1-CH1-CL; VH1-VH2-VL3-VH3-VL2-VL1-CL-CH1; VL1-VH2-VH3-VL3-VL2-VH1-CH1; VL1-VH2-VH3-VL3-VL2-VH1-CL; VL1-VH2-VH3-VL3-VL2-VH1-CH1-CL; VL1-VH2-VH3-VL3-VL2-VH1-CL-CH1; VH1-VL2-VL3-VH3-VH2-VL1-CH1; VH1-VL2-VL3-VH3-VH2-VL1-CL; VH1-VL2-VL3-VH3-VH2-VL1-CH1-CL; VH1-VL2-VL3-VH3-VH2-VL1-CL-CH1; VL1-L1-VL2-L2-VL3-L3-VH3-L4-VH2-L5-VH1-CH1; VL1-L1-VL2-L2-VL3-L3-VH3-L4-VH2-L5-VH1-L6-CH1; VL1-L1-VL2-L2-VL3-L3-VH3-L4-VH2-L5-VH1-CL; VL1-L1-VL2-L2-VL3-L3-VH3-L4-VH2-L5-VH1-L6-CL; VL1-L1-VL2-L2-VL3-L3-VH3-L4-VH2-L5-VH1-CH1-CL; VL1-L1-VL2-L2-VL3-L3-VH3-L4-VH2-L5-VH1-L6-CH1-CL; VL1-L1-VL2-L2-VL3-L3-VH3-L4-VH2-L5-VH1-L6-CH1-L7-CL; VL1-L1-VL2-L2-VL3-L3-VH3-L4-VH2-L5-VH1-CL-CH1; VL1-L1-VL2-L2-VL3-L3-VH3-L4-VH2- L5-VH1-L6-CL-CH1; VL1-L1-VL2-L2-VL3-L3-VH3-L4-VH2-L5-VH1-L6-CL-L7-CH1; VH1-L1-VH2-L2-VH3-L3- VL3-L4-VL2-L5-VL1-CH1; VH1-L1-VH2-L2-VH3-L3-VL3-L4-VL2-L5-VL1-L6-CH1; VH1-L1-VH2-L2-VH3-L3-VL3-L4-VL2-L5-VL1-CL; VH1-L1-VH2-L2-VH3-L3-VL3-L4-VL2-L5-VL1-L6-CL; VH1-L1-VH2-L2-VH3-L3-VL3- L4-VL2-L5-VL1-CH1-CL; VH1-L1-VH2-L2-VH3-L3-VL3-L4-VL2-L5-VL1-L6-CH1-CL; VH1-L1-VH2-L2-VH3-L3-VL3-L4-VL2-L5-VL1-L6-CH1-L7-CL; VH1-L1-VH2-L2-VH3-L3-VL3-L4-VL2-L5-VL1-CL-CH1; VH1-L1-VH2- L2-VH3-L3-VL3-L4-VL2-L5-VL1-L6-CL-CH1; VH1-L1-VH2-L2-VH3-L3-VL3-L4-VL2-L5-VL1-L6-CL-L7-CH1; VL1-L1-VH2-L2-VL3-L3-VH3-L4-VL2-L5-VH1-CH1; VL1-L1-VH2-L2-VL3-L3-VH3-L4-VL2-L5-VH1-L6-CH1; VL1-L1-VH2-L2-VL3-L3-VH3-L4-VL2-L5-VH1-CL; VL1-L1-VH2-L2-VL3-L3-VH3-L4-VL2-L5-VH1-L6-CL; VL1-L1-VH2-L2-VL3-L3-VH3-L4-VL2-L5-VH1-CH1-CL; VL1-L1-VH2-L2-VL3-L3-VH3-L4-VL2-L5-VH1-L6-CH1-CL; VL1-L1-VH2-L2-VL3-L3-VH3-L4-VL2-L5-VH1-L6-CH1-L7-CL; VL1-L1-VH2-L2-VL3-L3-VH3-L4-VL2-L5-VH1-CL-CH1; VL1-L1-VH2-L2-VL3-L3-VH3-L4-VL2-L5-VH1-L6-CL-CH1; VL1-L1-VH2-L2-VL3-L3-VH3-L4-VL2- L5-VH1-L6-CL-L7-CH1; VH1-L1-VL2-L2-

VH3-L3-VL3-L4-VH2-L5-VL1-CH1; VH1-L1-VL2-L2-VH3-L3-VL3-L4-VH2-L5-VL1-L6-CH1; VH1-L1-VL2-L2-VH3-L3-VL3-L4-VH2-L5-VL1-CL; VH1-L1-VL2-L2-VH3-L3-VL3-L4-VH2-L5-VL1-L6-CL; VH1-L1-VL2-L2-VH3-L3-VL3-L4-VH2-L5-VL1-CH1-CL; VH1-L1-VL2-L2-VH3-L3-VL3-L4-VH2-L5-VL1-L6-CH1-CL; VH1-L1-VL2-L2-VH3-L3-VL3-L4-VH2-L5-VL1-L6-CH1-L7-CL; VH1-L1-VL2-L2-VH3-L3-VL3-L4-VH2-L5-VL1-CL-CH1; VH1-L1-VL2-L2-VH3-L3-VL3-L4-VH2-L5-VL1-L6-CL-CH1; VH1-L1-VL2-L2-VH3-L3-VL3-L4-VH2-L5-VL1-L6-CL-L7-CH1; VL1-L1-VL2-L2-VH3-L3-VL3-L4-VH2-L5-VH1-CH1; VL1-L1-VL2-L2-VH3-L3-VL3-L4-VH2-L5-VH1-L6-CH1; VL1-L1-VL2-L2-VH3-L3-VL3-L4-VH2-L5-VH1-CL; VL1-L1-VL2-L2-VH3-L3-VL3-L4-VH2-L5-VH1-L6-CL; VL1-L1-VL2-L2-VH3-L3-VL3-L4-VH2-L5-VH1-CH1-CL; VL1-L1-VL2-L2-VH3-L3-VL3-L4-VH2-L5-VH1-L6-CH1-CL; VL1-L1-VL2-L2-VH3-L3-VL3-L4-VH2-L5-VH1-L6-CH1-L7-CL; VL1-L1-VL2-L2-VH3-L3-VL3-L4-VH2-L5-VH1-CL-CH1; VL1-L1-VL2-L2-VH3-L3-VL3-L4-VH2-L5-VH1-L6-CL-CH1; VL1-L1-VL2-L2-VH3-L3-VL3-L4-VH2-L5-VH1-L6-CL-L7-CH1; VH1-L1-VH2-L2-VL3-L3-VH3-L4-VL2-L5-VL1-CH1; VH1-L1-VH2-L2-VL3-L3-VH3-L4-VL2-L5-VL1-L6-CH1; VH1-L1-VH2-L2-VL3-L3-VH3-L4-VL2-L5-VL1-CL; VH1-L1-VH2-L2-VL3-L3-VH3-L4-VL2-L5-VL1-L6-CL; VH1-L1-VH2-L2-VL3-L3-VH3-L4-VL2-L5-VL1-CH1-CL; VH1-L1-VH2-L2-VL3-L3-VH3-L4-VL2-L5-VL1-L6-CH1-CL; VH1-L1-VH2-L2-VL3-L3-VH3-L4-VL2-L5-VL1-L6-CH1-L7-CL; VH1-L1-VH2-L2-VL3-L3-VH3-L4-VL2-L5-VL1-CL-CH1; VH1-L1-VH2-L2-VL3-L3-VH3-L4-VL2-L5-VL1-L6-CL-CH1; VH1-L1-VH2-L2-VL3-L3-VH3-L4-VL2-L5-VL1-L6-CL-L7-CH1; VL1-L1-VH2-L2-VH3-L3-VL3-L4-VL2-L5-VH1-CH1; VL1-L1-VH2-L2-VH3-L3-VL3-L4-VL2-L5-VH1-L6-CH1; VL1-L1-VH2-L2-VH3-L3-VL3-L4-VL2-L5-VH1-CL; VL1-L1-VH2-L2-VH3-L3-VL3-L4-VL2-L5-VH1-L6-CL; VL1-L1-VH2-L2-VH3-L3-VL3-L4-VL2-L5-VH1-CH1-CL; VL1-L1-VH2-L2-VH3-L3-VL3-L4-VL2-L5-VH1-L6-CH1-CL; VL1-L1-VH2-L2-VH3-L3-VL3-L4-VL2-L5-VH1-L6-CH1-L7-CL; VL1-L1-VH2-L2-VH3-L3-VL3-L4-VL2-L5-VH1-CL-CH1; VL1-L1-VH2-L2-VH3-L3-VL3-L4-VL2-L5-VH1-L6-CL-CH1; VL1-L1-VH2-L2-VH3-L3-VL3-L4-VL2-L5-VH1-L6-CL-L7-CH1; VH1-L1-VL2-L2-VL3-L3-VH3-L4-VH2-L5-VL1-CH1; VH1-L1-VL2-L2-VL3-L3-VH3-L4-VH2-L5-VL1-L6-CH1; VH1-L1-VL2-L2-VL3-L3-VH3-L4-VH2-L5-VL1-CL; VH1-L1-VL2-L2-VL3-L3-VH3-L4-VH2-L5-VL1-L6-CL; VH1-L1-VL2-L2-VL3-L3-VH3-L4-VH2-L5-VL1-CH1-CL; VH1-L1-VL2-L2-VL3-L3-VH3-L4-VH2-L5-VL1-L6-CH1-CL; VH1-L1-VL2-L2-VL3-L3-VH3-L4-VH2-L5-VL1-L6-CH1-L7-CL; VH1-L1-VL2-L2-VL3-L3-VH3-L4-VH2-L5-VL1-CL-CH1; VH1-L1-VL2-L2-VL3-L3-VH3-L4-VH2-L5-VL1-L6-CL-CH1; or VH1-L1-VL2-L2-VL3-L3-VH3-L4-VH2-L5-VL1-L6-CL-L7-CH1; wherein the second polypeptide has a structure represented by VL4-VH4-CH1; VL4-VH4-CL; VL4-VH4-CH1-CL; VL4-VH4-CL-CH1; VH4-VL4-CH1; VH4-VL4-CL; VH4-VL4-CH1-CL; VH4-VL4-CL-CH1; VL4-L8-VH4-CH1; VL4-L8-VH4-CL; VL4-L8-VH4-CH1-CL; VL4-L8-VH4-CL-CH1; VH4-L8-VL4-CH1; VH4-L8-VL4-CL; VH4-L8-VL4-CH1-CL; VH4-L8-VL4-CL-CH1; VL4-VL5-VH5-VH4-CH1; VL4-VL5-VH5-VH4-CL; VL4-VL5-VH5-VH4-CH1-CL; VL4-VL5-VH5-VH4-CL-CH1; VH4-VH5-VL5-VL4-CH1; VH4-VH5-VL5-VL4-CL; VH4-VH5-VL5-VL4-CH1-CL; VH4-VH5-VL5-VL4-CL-CH1; VL4-L8-VL5-L9-VH5-L10-VH4-CH1; VL4-L8-VL5-L9-VH5-L10-VH4-CL; VL4-L8-VL5-L9-VH5-L10-VH4-CH1-CL; VL4-L8-VL5-L9-VH5-L10-VH4-CL-CH1;

VH4-L8-VH5-L9-VL5-L10-VL4-CH1; VH4-L8-VH5-L9-VL5-L10-VL4-CL; VH4-L8-VH5-L9-VL5-L10-VL4-CH1-CL; VH4-L8-VH5-L9-VL5-L10-VL4-CL-CH1; VL4-VL5-VL6-VH6-VH5-VH4-CH1; VL4-VL5-VL6-VH6-VH5-VH4-CL; VL4-VL5-VL6-VH6-VH5-VH4-CH1-CL; VL4-VL5-VL6-VH6-VH5-VH4-CL-CH1; VH4-VH5-VH6-VL6-VL5-VL4-CH1; VH4-VH5-VH6-VL6-VL5-VL4-CL; VH4-VH5-VH6-VL6-VL5-VL4-CH1-CL; VH4-VH5-VH6-VL6-VL5-VL4-CL-CH1; VL4-VH5-VL6-VH6-VL5-VH4-CH1; VL4-VH5-VL6-VH6-VL5-VH4-CL; VL4-VH5-VL6-VH6-VL5-VH4-CH1-CL; VL4-VH5-VL6-VH6-VL5-VH4-CL-CH1; VH4-VL5-VH6-VL6-VH5-VL4-CH1; VH4-VL5-VH6-VL6-VH5-VL4-CL; VH4-VL5-VH6-VL6-VH5-VL4-CH1-CL; VH4-VL5-VH6-VL6-VH5-VL4-CL-CH1; VL4-VL5-VH6-VL6-VH5-VH4-CH1; VL4-VL5-VH6-VL6-VH5-VH4-CL; VL4-VL5-VH6-VL6-VH5-VH4-CH1-CL; VL4-VL5-VH6-VL6-VH5-VH4-CL-CH1; VH4-VH5-VL6-VH6-VL5-VL4-CH1; VH4-VH5-VL6-VH6-VL5-VL4-CL; VH4-VH5-VL6-VH6-VL5-VL4-CH1-CL; VH4-VH5-VL6-VH6-VL5-VL4-CL-CH1; VL4-VH5-VH6-VL6-VL5-VH4-CH1; VL4-VH5-VH6-VL6-VL5-VH4-CL; VL4-VH5-VH6-VL6-VL5-VH4-CH1-CL; VL4-VH5-VH6-VL6-VL5-VH4-CL-CH1; VH4-VL5-VL6-VH6-VH5-VL4-CH1; VH4-VL5-VL6-VH6-VH5-VL4-CL; VH4-VL5-VL6-VH6-VH5-VL4-CH1-CL; VH4-VL5-VL6-VH6-VH5-VL4-CL-CH1; VL4-L8-VL5-L9-VL6-L10-VH6-L11-VH5-L12-VH4-CH1; VL4-L8-VL5-L9-VL6-L10-VH6-L11-VH5-L12-VH4-CL; VL4-L8-VL5-L9-VL6-L10-VH6-L11-VH5-L12-VH4-CH1-CL; VL4-L8-VL5-L9-VL6-L10-VH6-L11-VH5-L12-VH4-CL-CH1; VH4-L8-VH5-L9-VH6-L10-VL6-L11-VL5-L12-VL4-CH1; VH4-L8-VH5-L9-VH6-L10-VL6-L11-VL5-L12-VL4-CL; VH4-L8-VH5-L9-VH6-L10-VL6-L11-VL5-L12-VL4-CH1-CL; VH4-L8-VH5-L9-VH6-L10-VL6-L11-VL5-L12-VL4-CL-CH1; VL4-L8-VH5-L9-VL6-L10-VH6-L11-VL5-L12-VH4-CH1; VL4-L8-VH5-L9-VL6-L10-VH6-L11-VL5-L12-VH4-CL; VL4-L8-VH5-L9-VL6-L10-VH6-L11-VL5-L12-VH4-CH1-CL; VL4-L8-VH5-L9-VL6-L10-VH6-L11-VL5-L12-VH4-CL-CH1; VH4-L8-VL5-L9-VH6-L10-VL6-L11-VH5-L12-VL4-CH1; VH4-L8-VL5-L9-VH6-L10-VL6-L11-VH5-L12-VL4-CL; VH4-L8-VL5-L9-VH6-L10-VL6-L11-VH5-L12-VL4-CH1-CL; VH4-L8-VL5-L9-VH6-L10-VL6-L11-VH5-L12-VL4-CL-CH1; VL4-L8-VL5-L9-VH6-L10-VL6-L11-VH5-L12-VH4-CH1; VL4-L8-VL5-L9-VH6-L10-VL6-L11-VH5-L12-VH4-CL; VL4-L8-VL5-L9-VH6-L10-VL6-L11-VH5-L12-VH4-CH1-CL; VL4-L8-VL5-L9-VH6-L10-VL6-L11-VH5-L12-VH4-CL-CH1; VH4-L8-VH5-L9-VL6-L10-VH6-L11-VL5-L12-VL4-CH1; VH4-L8-VH5-L9-VL6-L10-VH6-L11-VL5-L12-VL4-CL; VH4-L8-VH5-L9-VL6-L10-VH6-L11-VL5-L12-VL4-CH1-CL; VH4-L8-VH5-L9-VL6-L10-VH6-L11-VL5-L12-VL4-CL-CH1; VL4-L8-VH5-L9-VH6-L10-VL6-L11-VL5-L12-VH4-CH1; VL4-L8-VH5-L9-VH6-L10-VL6-L11-VL5-L12-VH4-CL; VL4-L8-VH5-L9-VH6-L10-VL6-L11-VL5-L12-VH4-CH1-CL; VL4-L8-VH5-L9-VH6-L10-VL6-L11-VL5-L12-VH4-CL-CH1; VH4-L8-VL5-L9-VL6-L10-VH6-L11-VH5-L12-VL4-CH1; VH4-L8-VL5-L9-VL6-L10-VH6-L11-VH5-L12-VL4-CL; VH4-L8-VL5-L9-VL6-L10-VH6-L11-VH5-L12-VL4-CH1-CL; VH4-L8-VL5-L9-VL6-L10-VH6-L11-VH5-L12-VL4-CL-CH1; VL4-L8-VL5-L9-VL6-L10-VH6-L11-VH5-L12-VH4-CH1; VL4-L8-VL5-L9-VL6-L10-VH6-L11-VH5-L12-VH4-L13-CL; VL4-L8-VL5-L9-VL6-L10-VH6-L11-VH5-L12-VH4-L13-CH1-CL; VL4-L8-VL5-L9-VL6-L10-VH6-L11-VH5-L12-VH4-L13-CL-CH1; VH4-L8-VH5-L9-VH6-L10-VL6-L11-VL5-L12-VL4-L13-CH1; VH4-L8-VH5-L9-VH6-L10-VL6-L11-VL5-L12-VL4-L13-

CL; VH4-L8-VH5-L9-VH6-L10-VL6-L11-VL5-L12-VL4-L13-CH1-CL; VH4-L8-VH5-L9-VH6-L10-VL6-L11-VL5-L12-VL4-L13-CL-CH1; VL4-L8-VH5-L9-VL6-L10-VH6-L11-VL5-L12-VH4-L13-CH1; VL4-L8-VH5-L9-VL6-L10-VH6-L11-VL5-L12-VH4-L13-CL; VL4-L8-VH5-L9-VL6-L10-VH6-L11-VL5-L12-VH4-L13-CH1-CL; VL4-L8-VH5-L9-VL6-L10-VH6-L11-VL5-L12-VH4-L13-CL-CH1; VH4-L8-VL5-L9-VH6-L10-VL6-L11-VH5-L12-VL4-L13-CH1; VH4-L8-VL5-L9-VH6-L10-VL6-L11-VH5-L12-VL4-L13-CL; VH4-L8-VL5-L9-VH6-L10-VL6-L11-VH5-L12-VL4-L13-CH1-CL; VH4-L8-VL5-L9-VH6-L10-VL6-L11-VH5-L12-VL4-L13-CL-CH1; VL4-L8-VL5-L9-VH6-L10-VL6-L11-VH5-L12-VH4-L13-CH1; VL4-L8-VL5-L9-VH6-L10-VL6-L11-VH5-L12-VH4-L13-CL; VL4-L8-VL5-L9-VH6-L10-VL6-L11-VH5-L12-VH4-L13-CH1-CL; VL4-L8-VL5-L9-VH6-L10-VL6-L11-VH5-L12-VH4-L13-CL-CH1; VH4-L8-VH5-L9-VL6-L10-VH6-L11-VL5-L12-VL4-L13-CH1; VH4-L8-VH5-L9-VL6-L10-VH6-L11-VL5-L12-VL4-L13-CL; VH4-L8-VH5-L9-VL6-L10-VH6-L11-VL5-L12-VL4-L13-CH1-CL; VH4-L8-VH5-L9-VL6-L10-VH6-L11-VL5-L12-VL4-L13-CL-CH1; VL4-L8-VH5-L9-VH6-L10-VL6-L11-VL5-L12-VH4-L13-CH1; VL4-L8-VH5-L9-VH6-L10-VL6-L11-VL5-L12-VH4-L13-CL; VL4-L8-VH5-L9-VH6-L10-VL6-L11-VL5-L12-VH4-L13-CH1-CL; VL4-L8-VH5-L9-VH6-L10-VL6-L11-VL5-L12-VH4-L13-CH1; VH4-L8-VL5-L9-VL6-L10-VH6-L11-VH5-L12-VL4-L13-CH1; VH4-L8-VL5-L9-VL6-L10-VH6-L11-VH5-L12-VL4-L13-CH1; VH4-L8-VL5-L9-VL6-L10-VH6-L11-VH5-L12-VL4-L13-CL; VH4-L8-VL5-L9-VL6-L10-VH6-L11-VH5-L12-VL4-L13-CH1-CL; or VH4-L8-VL5-L9-VL6-L10-VH6-L11-VH5-L12-VL4-L13-CL-CH1; wherein VL1 is a first immunoglobulin light chain variable region; VL2 is a second immunoglobulin light chain variable region; VL3 is a third immunoglobulin light chain variable region; VL4 is a fourth immunoglobulin light chain variable region; VL5 is a fifth immunoglobulin light chain variable region; VL6 is a sixth immunoglobulin light chain variable region; VH1 is a first immunoglobulin heavy chain variable region; VH2 is a second immunoglobulin heavy chain variable region; VH3 is a third immunoglobulin heavy chain variable region; VH4 is a fourth immunoglobulin heavy chain variable region; VH5 is a fifth immunoglobulin heavy chain variable region; VH6 is a sixth immunoglobulin heavy chain variable region; CH1 is a heavy chain constant region 1; CL is a light chain constant region; and L1, L2, L3, L4, L5, L6, L7, L8, L9, L10, L11, L12 and L13 are amino acid linkers.

Provided herein is an antigen binding polypeptide complex comprising a first polypeptide and a second polypeptide; wherein the first polypeptide has a structure represented by VL1-VL2-VL3-VH3-VH2-VH1-CH1-Fc; VH1-VH2-VH3-VL3-VL2-VL1-CH1-Fc; VL1-VH2-VL3-VH3-VL2-VH1-CH1-Fc; VH1-VL2-VH3-VL3-VH2-VL1-CH1-Fc; VL1-VL2-VH3-VL3-VH2-VH1-CH1-Fc; VH1-VH2-VL3-VH3-VL2-VL1-CH1-Fc; VL1-VH2-VH3-VL3-VL2-VH1-CH1-Fc; VH1-VL2-VL3-VH3-VH2-VL1-CH1-Fc; VL1-VL2-VL3-VH3-VH2-VH1-CL-Fc; VH1-VH2-VH3-VL3-VL2-VL1-CL-Fc; VL1-VH2-VL3-VH3-VL2-VH1-CL-Fc; VH1-VL2-VH3-VL3-VH2-VL1-CL-Fc; VL1-VL2-VH3-VL3-VH2-VH1-CL-Fc; VH1-VH2-VL3-VH3-VL2-VL1-CL-Fc; VL1-VH2-VH3-VL3-VL2-VH1-CL-Fc; VH1-VL2-VL3-VH3-VH2-VL1-CH1-CL-Fc; VH1-VH2-VL3-VH3-VL2-VL1-CH1-CL-Fc; VL1-VH2-VH3-VL3-VL2-VH1-CH1-CL-Fc; VH1-VL2-VL3-VH3-VH2-VL1-CH1-CL-Fc; VH1-VL2-VL3-VH3-VH2-VL1-CH1-CL-Fc; VL1-VH2-VH3-VL3-VL2-VH1-CH1-CL-Fc; VH1-VL2-VL3-VH3-VH2-VL1-CH1-CL-Fc; VL1-

VL2-VL3-VH3-VH2-VH1-CL-CH1-Fc; VH1-VH2-VH3-VL3-VL2-VL1-CL-CH1-Fc; VL1-VH2-VL3-VH3-VL2-VH1-CL-CH1-Fc; VH1-VL2-VH3-VL3-VH2-VL1-CL-CH1-Fc; VL1-VL2-VH3-VL3-VH2-VH1-CL-CH1-Fc; VH1-VH2-VL3-VH3-VL2-VL1-CL-CH1-Fc; VL1-VH2-VH3-VL3-VL2-VH1-CL-CH1-Fc; VH1-VL2-VL3-VH3-VH2-VL1-CL-CH1-Fc; VL1-L1-VL2-L2-VL3-L3-VH3-L4-VH2-L5-VH1-CH1-Fc; VH1-L1-VH2-L2-VH3-L3-VL3-L4-VL2-L5-VL1-CH1-Fc; VL1-L1-VH2-L2-VL3-L3-VH3-L4-VL2-L5- VH1-CH1-Fc; VH1-L1-VL2-L2-VH3-L3-VL3-L4-VH2-L5-VL1-CH1-Fc; VL1-L1-VL2-L2-VH3-L3-VL3-L4-VH2-L5- VH1-CH1-Fc; VH1-L1-VH2-L2-VL3-L3-VH3-L4-VL2-L5-VL1-CH1-Fc; VL1-L1-VH2-L2-VH3-L3-VL3-L4-VL2-L5- VH1-CH1-Fc; VH1-L1-VL2-L2-VL3-L3-VH3-L4-VH2-L5-VL1-CH1-Fc; VL1-L1-VL2-L2-VL3-L3-VH3-L4-VH2-L5- VH1-CL-Fc; VH1-L1-VH2-L2-VH3-L3-VL3-L4-VL2-L5-VL1-CL-Fc; VL1-L1-VH2-L2-VL3-L3-VH3-L4-VL2-L5-VH1-CL-Fc; VH1-L1-VL2-L2-VH3-L3-VL3-L4-VH2-L5-VL1-CL-Fc; VL1-L1-VL2-L2-VH3-L3-VL3-L4-VH2-L5-VH1-CL-Fc; VH1-L1-VH2-L2-VL3-L3-VH3-L4-VL2-L5-VL1-CL-Fc; VL1-L1-VH2-L2-VH3-L3-VL3-L4-VL2-L5-VH1-CL-Fc; VH1-L1-VL2-L2-VL3-L3-VH3-L4-VH2-L5-VH1-CL-Fc; VL1-L1-VL2-L2-VL3-L3-VH3-L4-VH2-L5-VH1-CH1-CL-Fc; VH1-L1-VH2-L2-VH3-L3-VL3-L4-VL2-L5-VL1-CH1-CL-Fc; VL1-L1-VH2-L2-VL3-L3-VH3-L4-VL2-L5-VH1-CH1-CL-Fc; VH1-L1-VL2-L2-VH3-L3-VL3-L4-VH2-L5-VL1-CH1-CL-Fc; VL1-L1-VL2-L2-VH3-L3-VL3-L4-VH2-L5-VH1-CH1-CL-Fc; VH1-L1-VH2-L2-VL3-L3-VH3-L4-VL2-L5-VL1-CH1-CL-Fc; VL1-L1-VH2-L2-VH3-L3-VL3-L4-VL2-L5-VH1-CH1-CL-Fc; VH1-L1-VL2-L2-VL3-L3-VH3-L4-VH2-L5-VL1-CH1-CL-Fc; VL1-L1-VL2-L2-VL3-L3-VH3-L4-VH2-L5-VH1-CL-CH1-Fc; VH1-L1-VH2-L2-VH3-L3-VL3-L4-VL2-L5-VL1-CH1-CL-Fc; VL1-L1-VL2-L2-VL3-L3-VH3-L4-VH2-L5-VH1-CL-CH1-Fc; VH1-L1-VH2-L2-VH3-L3-VL3-L4-VL2-L5-VL1-CL-CH1-Fc; VL1-L1-VH2-L2-VL3-L3-VH3-L4-VL2-L5-VH1-CL-CH1-Fc; VH1-L1-VL2-L2-VH3-L3-VL3-L4-VH2-L5-VL1-CL-CH1-Fc; VL1-L1-VL2-L2-VH3-L3-VL3-L4-VH2-L5-VH1-CL-CH1-Fc; VH1-L1-VH2-L2-VL3-L3-VH3-L4-VL2-L5-VL1-CL-CH1-Fc; VL1-L1-VH2-L2-VH3-L3-VL3-L4-VL2-L5-VH1-CL-CH1-Fc; or VH1-L1-VL2-L2-VL3-L3-VH3-L4-VH2-L5-VL1-CL-CH1-Fc; wherein the second polypeptide has a structure represented by Fc; VL4-VH4-CH1-Fc; VL4-VH4-CL-Fc; VL4-VH4-CL-CH1-Fc; VL4-VH4-CH1-Fc; VH4-VL4-CH1-Fc; VH4-VL4-CL-Fc; VH4-VL4-CH1-CL-Fc; VH4-VL4-CL-CH1-Fc; VL4-L6-VH4-CH1-Fc; VL4-L6-VH4-CL-Fc; VL4-L6-VH4-CH1-CL-Fc; VL4-L6-VH4-CL-CH1-Fc; VH4-L6-VL4-CH1-Fc; VH4-L6-VL4-CL-Fc; VH4-L6-VL4-CH1-CL-Fc; VH4-L6-VL4-CL-CH1-Fc; VL4-CL-VH4-CH1-Fc; VH4-CL-VL4-CH1-Fc; VL4-CH1-VH4-CL-Fc; VH4-CH1-VL4-CL-Fc; VL4-L6-CL-L7-VH4-L8-CH1-Fc; VL4-L6-CL-L7-VH4-L8-CH1-L9-Fc; VH4-L6-CL-L7-VL4-L8-CH1-Fc; VH4-L6-CL-L7-VL4-L8-CH1-L9-Fc; VL4-L6-CH1-L7-VH4-L8-CL-Fc; VL4-L6-CH1-L7-VH4-L8-CL-L9-Fc; VH4-L6-CH1-L7-VL4-L8-CL-Fc; VH4-L6-CH1-L7-VL4-L8-CL-L9-Fc; VL4-VL5-VH5-VH4-CH1-Fc; VL4-VL5-VH5-VH4-CL-Fc; VL4-VL5-VH5-VH4-CH1-CL-Fc; VL4-VL5-VH5-VH4-CL-CH1-Fc; VH4-VH5-VL5-VL4-CH1-Fc; VH4-VH5-VL5-VL4-CL-Fc; VH4-VH5-VL5-VL4-CH1-CL-Fc; VH4-VH5-VL5-VL4-CL-CH1-Fc; VL4-L6-VL5-L7-VH5-L8-VH4-CH1-Fc; VL4-L6-VL5-L7-VH5-L8-VH4-CL-Fc; VL4-L6-VL5-L7-VH5-L8-VH4-CH1-CL-Fc; VL4-L6-VL5-L7-VH5-L8-VH4-CL-CH1-Fc; VH4-L6-VH5-L7-VL5-L8-VL4-CH1-Fc; VH4-L6-VH5-L7-VL5-L8-VL4-CL-Fc; VH4-L6-VH5-L7-VL5-L8-VL4-CH1-CL-Fc; VH4-L6-VH5-L7-VL5-L8-VL4-CL-CH1-Fc; VL4-VL5-VL6-

VH6-VH5-VH4-CH1-Fc; VL4-VL5-VL6-VH6-VH5-VH4-CL-Fc; VL4-VL5-VL6-VH6-VH5-VH4-CH1-CL-Fc; VL4-VL5-VL6-VH6-VH5-VH4-CL-CH1-Fc; VH4-VH5-VH6-VL6-VL5-VL4-CH1-Fc; VH4-VH5-VH6-VL6-VL5-VL4-CL-Fc; VH4-VH5-VH6-VL6-VL5-VL4-CH1-CL-Fc; VH4-VH5-VH6-VL6-VL5-VL4-CL-CH1-Fc; VL4-VH5-VL6-VH6-VL5-VH4-CH1-Fc; VL4-VH5-VL6-VH6-VL5-VH4-CL-Fc; VL4-VH5-VL6-VH6-VL5-VH4-CH1-CL-Fc; VL4-VH5-VL6-VH6-VL5-VH4-CL-CH1-Fc; VH4-VL5-VH6-VL6-VH5-VL4-CH1-Fc; VH4-VL5-VH6-VL6-VH5-VL4-CL-Fc; VH4-VL5-VH6-VL6-VH5-VL4-CH1-CL-Fc; VH4-VL5-VH6-VL6-VH5-VL4-CL-CH1-Fc; VL4-VL5-VH6-VL6-VH5-VH4-CH1-Fc; VL4-VL5-VH6-VL6-VH5-VH4-CL-Fc; VL4-VL5-VH6-VL6-VH5-VH4-CH1-CL-Fc; VL4-VL5-VH6-VL6-VH5-VH4-CL-CH1-Fc; VH4-VH5-VL6-VH6-VL5-VL4-CH1-Fc; VH4-VH5-VL6-VH6-VL5-VL4-CL-Fc; VH4-VH5-VL6-VH6-VL5-VL4-CH1-CL-Fc; VH4-VH5-VL6-VH6-VL5-VL4-CL-CH1-Fc; VL4-VH5-VH6-VL6-VL5-VH4-CH1-Fc; VL4-VH5-VH6-VL6-VL5-VH4-CL-Fc; VL4-VH5-VH6-VL6-VL5-VH4-CH1-CL-Fc; VL4-VH5-VH6-VL6-VL5-VH4-CL-CH1-Fc; VH4-VL5-VL6-VH6-VH5-VL4-CH1-Fc; VH4-VL5-VL6-VH6-VH5-VL4-CL-Fc; VH4-VL5-VL6-VH6-VH5-VL4-CH1-CL-Fc; VH4-VL5-VL6-VH6-VH5-VL4-CL-CH1-Fc; VL4-L6-VL5-L7-VL6-L8-VH6-L9-VH5-L10-VH4-CH1-Fc; VL4-L6-VL5-L7-VL6-L8-VH6-L9-VH5-L10-VH4-CL-Fc; VL4-L6-VL5-L7-VL6-L8-VH6-L9-VH5-L10-VH4-CH1-CL-Fc; VL4-L6-VL5-L7-VL6-L8-VH6-L9-VH5-L10-VH4-CL-CH1-Fc; VH4-L6-VH5-L7-VH6-L8-VL6-L9-VL5-L10-VL4-CH1-Fc; VH4-L6-VH5-L7-VH6-L8-VL6-L9-VL5-L10-VL4-CL-Fc; VH4-L6-VH5-L7-VH6-L8-VL6-L9-VL5-L10-VL4-CH1-CL-Fc; VH4-L6-VH5-L7-VH6-L8-VL6-L9-VL5-L10-VL4-CL-CH1-Fc; VL4-L6-VH5-L7-VL6-L8-VH6-L9-VL5-L10-VH4-CH1-Fc; VL4-L6-VH5-L7-VL6-L8-VH6-L9-VL5-L10-VH4-CL-Fc; VL4-L6-VH5-L7-VL6-L8-VH6-L9-VL5-L10-VH4-CH1-CL-Fc; VL4-L6-VH5-L7-VL6-L8-VH6-L9-VL5-L10-VH4-CL-CH1-Fc; VH4-L6-VL5-L7-VH6-L8-VL6-L9-VH5-L10-VL4-CH1-Fc; VH4-L6-VL5-L7-VH6-L8-VL6-L9-VH5-L10-VL4-CL- Fc; VH4-L6-VL5-L7-VH6-L8-VL6-L9-VH5-L10-VL4-CH1-CL-Fc; VH4-L6-VL5-L7-VH6-L8-VL6-L9-VH5-L10-VL4-CL-CH1-Fc; VL4-L6-VL5-L7-VH6-L8-VL6-L9-VH5-L10-VH4-CH1-Fc; VL4-L6-VL5-L7-VH6-L8-VL6-L9-VH5-L10-VH4-CL-Fc; VL4-L6-VL5-L7-VH6-L8-VL6-L9-VH5-L10-VH4-CH1-CL-Fc; VL4-L6-VL5-L7-VH6-L8-VL6-L9-VH5-L10-VH4-CL-CH1-Fc; VH4-L6-VH5-L7-VL6-L8-VH6-L9-VL5-L10-VH4-CH1-Fc; VH4-L6-VH5-L7-VL6-L8-VH6-L9-VL5-L10-VH4-CL-Fc; VH4-L6-VH5-L7-VL6-L8-VH6-L9-VL5-L10-VH4-CH1-CL-Fc; VH4-L6-VH5-L7-VL6-L8-VH6-L9-VL5-L10-VH4-CL-CH1-Fc; VL4-L6-VH5-L7-VH6-L8-VL6-L9-VH5-L10-VH4-CH1-Fc; VL4-L6-

VH5-L7-VH6-L8-VL6-L9-VL5-L10-VL4-L11-CH1-CL-Fc; VH4-L6-VH5-L7-VH6-L8-VL6-L9-VL5-L10-VL4-L11-CL-CH1-Fc; VL4-L6-VH5-L7-VL6-L8-VH6-L9-VL5-L10-VH4-L11-CH1-Fc; VL4-L6-VH5-L7-VL6-L8-VH6-L9-VL5-L10-VH4-L11-CL-Fc; VL4-L6-VH5-L7-VL6-L8-VH6-L9-VL5-L10-VH4-L11-CH1-CL-Fc; VL4-L6-VH5-L7-VL6-L8-VH6-L9-VL5-L10-VH4-L11-CL-CH1-Fc; VL4-L6-VH5-L7-VL6-L8-VH6-L9-VL5-L10-VH4-L11-CL-CH1-Fc; VH4-L6-VL5-L7-VH6-L8-VL6-L9-VH5-L10-VL4-L11-CH1-Fc; VH4-L6-VL5-L7-VH6-L8-VL6-L9-VH5-L10-VL4-L11-CL-Fc; VH4-L6-VL5-L7-VH6-L8-VL6-L9-VH5-L10-VL4-L11-CH1-CL-Fc; VH4-L6-VL5-L7-VH6-L8-VL6-L9-VH5-L10-VL4-L11-CL-CH1-Fc; VL4-L6-VL5-L7-VH6-L8-VL6-L9-VH5-L10-VH4-L11-CH1-Fc; VL4-L6-VL5-L7-VH6-L8-VL6-L9-VH5-L10-VH4-L11-CL-Fc; VL4-L6-VL5-L7-VH6-L8-VL6-L9-VH5-L10-VH4-L11-CH1-CL-Fc; VL4-L6-VL5-L7-VH6-L8-VL6-L9-VH5-L10-VH4-L11-CL-CH1-Fc; VH4-L6-VH5-L7-VL6-L8-VH6-L9-VL5-L10-VH4-L11-CH1-Fc; VH4-L6-VH5-L7-VL6-L8-VH6-L9-VL5-L10-VH4-L11-CL-Fc; VH4-L6-VH5-L7-VL6-L8-VH6-L9-VL5-L10-VH4-L11-CH1-CL-Fc; VL4-L6-VH5-L7-VH6-L8-VL6-L9-VL5-L10-VH4-L11-CH1-Fc; VL4-L6-VH5-L7-VH6-L8-VL6-L9-VL5-L10-VH4-L11-CL-Fc; VL4-L6-VH5-L7-VH6-L8-VL6-L9-VL5-L10-VH4-L11-CH1-CL-Fc; VL4-L6-VH5-L7-VH6-L8-VL6-L9-VL5-L10-VH4-L11-CL-CH1-Fc; VH4-L6-VL5-L7-VL6-L8-VH6-L9-VH5-L10-VL4-L11-CH1-Fc; VH4-L6-VL5-L7-VL6-L8-VH6-L9-VH5-L10-VL4-L11- CL-Fc; VH4-L6-VL5-L7-VL6-L8-VH6-L9-VH5-L10-VL4-L11-CH1-CL-Fc; or VH4-L6-VL5-L7-VL6-L8-VH6-L9-VH5-L10-VL4-L11-CL-CH1-Fc; wherein VL1 is a first immunoglobulin light chain variable region; VL2 is a second immunoglobulin light chain variable region; VL3 is a third immunoglobulin light chain variable region; VL4 is a fourth immunoglobulin light chain variable region; VL5 is a fifth immunoglobulin light chain variable region; VL6 is a sixth immunoglobulin light chain variable region; VH1 is a first immunoglobulin heavy chain variable region; VH2 is a second immunoglobulin heavy chain variable region; VH3 is a third immunoglobulin heavy chain variable region; VH4 is a fourth immunoglobulin heavy chain variable region; VH5 is a fifth immunoglobulin heavy chain variable region; VH6 is a sixth immunoglobulin heavy chain variable region; Fc is a region comprising an immunoglobulin heavy chain constant region 2 (CH2), an immunoglobulin heavy chain constant region 3 (CH3), and optionally, an immunoglobulin hinge; CH1 is a heavy chain constant region 1; CL is a light chain constant region; and L1, L2, L3, L4, L5, L6, L7, L8, L9, L10 and L11 are amino acid linkers.

Provided herein is an antigen binding polypeptide having a structure represented by VL1-VL2-VL3-VH3-VH2-VH1-CH3-CH3; VH1-VH2-VH3-VL3-VL2-VL1-CH3-CH3; VL1-VH2-VL3-VH3-VL2-VH1-CH3-CH3; VH1-VL2-VH3-VL3-VH2-VL1-CH3-CH3; VL1-VL2-VH3-VL3-VH2-VH1-CH3-CH3; VH1-VH2-VL3-VH3-VL2-VL1-CH3-CH3; VL1-VH2-VH3-VL3-VL2-VH1-CH3-CH3; VH1-VL2-VL3-VH3-VH2-VL1-CH3-CH3; VL1-L1-VL2-L2-VL3-L3-VH3-L4-VH2-L5-VH1-CH3-CH3; VH1-L1-VH2-L2-VH3-L3-VL3-L4-VL2-L5-VL1-CH3-CH3; VL1-L1-VH2-L2-VL3-L3-VH3-L4-VL2-L5-VH1-CH3-CH3; VH1-L1-VL2-L2-VH3-L3-VL3-L4-VH2-L5-VL1-CH3-CH3; VL1-L1-VL2-L2-VH3-L3-VL3-L4-VH2-L5-VH1-CH3-CH3; VH1-L1-VH2-L2-VL3-L3-VH3-L4-VL2-L5-VL1-CH3-CH3; VL1-L1-VH2-L2-VH3-L3-VL3-L4-VL2-L5-VH1-CH3-CH3; VH1-L1-VL2-L2-VL3-L3-VH3-L4-VH2-L5-VL1-CH3-CH3; VL1-L1-VL2-L2-VL3-L3-VH3-

L4-VH2-L5-VH1-L6-CH3-CH3; VH1-L1-VH2-L2-VH3-L3-VL3-L4-VL2-L5-VL1-L6-CH3-CH3; VL1-L1-VH2-L2-VL3-L3-VH3-L4-VL2-L5-VH1-L6-CH3-CH3; VH1-L1-VL2-L2-VH3-L3-VL3-L4-VH2-L5-VL1-L6-CH3-CH3; VL1-L1-VL2-L2-VH3-L3-VL3-L4-VH2-L5-VH1-L6-CH3-CH3; VH1-L1-VH2-L2-VL3-L3-VH3-L4-VL2-L5-VL1-L6-CH3-CH3; VL1-L1-VH2-L2-VH3-L3-VL3-L4-VL2-L5-VH1-L6-CH3-CH3; VH1-L1-VL2-L2-VL3-L3-VH3-L4-VH2-L5-VL1-L6-CH3-CH3; VL1-L1-VL2-L2-VL3-L3-VH3-L4-VH2-L5-VH1-L6-CH3-L7-CH3; VH1-L1-VH2-L2-VH3-L3-VL3-L4-VL2-L5-VL1-L6-CH3-L7-CH3; VL1-L1-VH2-L2-VL3-L3-VH3-L4-VL2-L5-VH1-L6-CH3-L7-CH3; VH1-L1-VL2-L2-VH3-L3-VL3-L4-VH2-L5-VL1-L6-CH3-L7-CH3; VL1-L1-VL2-L2-VH3-L3-VL3-L4-VH2-L5-VH1-L6-CH3-L7-CH3; VH1-L1-VH2-L2-VL3-L3-VH3-L4-VL2-L5-VL1-L6-CH3-L7-CH3; VL1-L1-VH2-L2-VH3-L3-VL3-L4-VL2-L5-VH1-L6-CH3-L7-CH3; or VH1-L1-VL2-L2-VL3-L3-VH3-L4-VH2-L5-VL1-L6-CH3-L7-CH3; wherein VL1 is a first immunoglobulin light chain variable region; VL2 is a second immunoglobulin light chain variable region; VL3 is a third immunoglobulin light chain variable region; VH1 is a first immunoglobulin heavy chain variable region; VH2 is a second immunoglobulin heavy chain variable region; VH3 is a third immunoglobulin heavy chain variable region; CH3 is an immunoglobulin heavy chain constant region 3; and L1, L2, L3, L4, L5, L6 and L7 are amino acid linkers.

Provided herein is an antigen binding polypeptide complex comprising a first polypeptide, a second polypeptide, and a third polypeptide; wherein the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; wherein the second polypeptide has a structure represented by VL4-VL5; VL4-L6-VL5; VL4-VL5-VL6; or VL4-L6-VL5-L7-VL6; wherein the third polypeptide has a structure represented by VH4-VH5; VH4-L6-VH5; VH4-VH5-VH6; or VH4-L6-VH5-L7-VH6; wherein VL1 is a first immunoglobulin light chain variable region; VL2 is a second immunoglobulin light chain variable region; VL3 is a third immunoglobulin light chain variable region; VL4 is a fourth immunoglobulin light chain variable region; VL5 is a fifth immunoglobulin light chain variable region; VL6 is a sixth immunoglobulin light chain variable region; VH1 is a first immunoglobulin heavy chain variable region; VH2 is a second immunoglobulin heavy chain variable region; VH3 is a third immunoglobulin heavy chain variable region; VH4 is a fourth immunoglobulin heavy chain variable region; VH5 is a fifth immunoglobulin heavy chain variable region; VH6 is a sixth immunoglobulin heavy chain variable region; and L1, L2, L3, L4, L5, L6 and L7 are amino acid linkers.

Provided herein is an antigen binding polypeptide complex comprising a first polypeptide, a second polypeptide, and a third polypeptide; wherein the first polypeptide has a structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc;

VL1-VL2-VH3-VL3-VH2-VH1-Fc; VH1-VH2-VL3-VH3-VL2-VL1-Fc; VL1-VH2-VH3-VL3-VL2-VH1-Fc; VH1-VL2-VL3-VH3-VH2-VL1-Fc; VL1-L1-VL2-L2-VL3-L3-VH3-L4-VH2-L5-VH1-Fc; VL1-L1-VL2-L2-VL3-L3-VH3-L4-VH2-L5-VH1-L6-Fc; VH1-L1-VH2-L2-VH3-L3-VL3-L4-VL2-L5-VL1-Fc; VH1-L1-VH2-L2-VH3-L3-VL3-L4-VL2-L5-VL1-L6-Fc; VL1-L1-VH2-L2-VL3-L3-VH3-L4-VL2-L5-VH1-Fc; VL1-L1-VH2-L2-VL3-L3-VH3- L4-VL2-L5-VH1-L6-Fc; VH1-L1-VL2-L2-VH3-L3-VL3-L4-VH2-L5-VL1-Fc; VH1-L1-VL2-L2-VH3-L3-VL3-L4- VH2-L5-VL1-L6-Fc; VL1-L1-VH2-L2-VL3-L3-VH3-L4-VH2-L5-VH1-Fc; VL1-L1-VH2-L2-VL3-L3-VH3-L4-VH2- L5-VH1-L6-Fc; VH1-L1-VH2-L2-VL3-L3-VH3-L4-VL2-L5-VL1-Fc; VH1-L1-VL2-L2-VH3-L3-VL3-L4-VL2-L5- VL1-L6-Fc; VL1-L1-VH2-L2-VH3-L3-VL3-L4-VL2-L5-VH1-Fc; VL1-L1-VH2-L2-VH3-L3-VL3-L4-VL2-L5-VH1- L6-Fc; VH1-L1-VL2-L2-VL3-L3-VH3-L4-VH2-L5-VL1-Fc; or VH1-L1-VL2-L2-VL3-L3-VH3-L4-VH2-L5-VL1-L6-Fc; wherein the second polypeptide has a structure represented by VL4-VL5; VL4-L7-VL5; VL4-CL; VL4-L7-CL; VL4-CH1; VL4-L7-CH1; VH4-VH5; VH4-L7-VH5; VH4-CL; VH4-L7-CL; VH4-CH1; VH4-L7-CH1; VL4-VL5-VL6; VL4-L7-VL5-L8-VL6; VL4-VL5-VL6-CL; VL4-L7-VL5-L8-VL6-CL; VL4-L7-VL5-L8-VL6-L9-CL; VL4-VL5-VL6-CH1; VL4-L7-VL5-L8-VL6-CH1; VL4-L7-VL5-L8-VL6-L9-CH1; VH4-VH5-VH6; VH4-L7-VH5-L8-VH6; VH4-VH5-VH6-CL; VH4-L7-VH5-L8-VH6-CL; VH4-L7-VH5-L8-VH6-L9-CL; VH4-VH5-VH6-CH1; VH4-L7-VH5-L8-VH6-CH1; or VH4-L7-VH5-L8-VH6-L9-CH1; wherein the third polypeptide has a structure represented by VH4-VH5-Fc; VH4-L10-VH5-Fc; VH4-L10-VH5-L11-Fc; VH4-CH1-Fc; VH4-L10-CH1-Fc; VH4-L10-CH1-L11-Fc; VH4-CL-Fc; VH4-L10-CL-Fc; VH4-L10-CL-L11-Fc; VH4-VH5-Fc; VH4-L10-VH5-Fc; VH4-L10-VH5-L11-Fc; VH4-VH5-VH6-Fc; VH4-L10-VH5-L11-VH6-Fc; VH4-L10-VH5-L11-VH6-L12-Fc; VH4-VH5-VH6-CH1-Fc; VH4-L10-VH5-L11-VH6-CH1-Fc; VH4-L10-VH5-L11-VH6-L12-CH1-Fc; VH4-VH5-VH6-CL-Fc; VH4-L10-VH5-L11-VH6-CL-Fc; VH4-L10-VH5-L11-VH6-L12-CL-Fc; VH4-L10-VH5-L11-VH6-L12-CL-L13-Fc; VL4-VL5-VL6-Fc; VL4-L10-VL5-L11-VL6-Fc; VL4-L10-VL5-L11-VL6-L12-Fc; VL4-VL5-VL6-CH1-Fc; VL4-L10-VL5-L11-VL6-CH1-Fc VL4-L10-VL5-L11-VL6-L12-CH1-Fc; VL4-L10-VL5-L11-VL6-L12-CH1-L13-Fc; VL4-VL5-VL6-CL-Fc; VL4-L10-VL5-L11-VL6-CL-Fc; VL4-L10-VL5-L11-VL6-L12-CL-Fc; or VL4-L10-VL5-L11-VL6-L12-CL-L13-Fc; wherein VL1 is a first immunoglobulin light chain variable region; VL2 is a second immunoglobulin light chain variable region; VL3 is a third immunoglobulin light chain variable region; VL4 is a fourth immunoglobulin light chain variable region; VL5 is a fifth immunoglobulin light chain variable region; VL6 is a sixth immunoglobulin light chain variable region; VH1 is a first immunoglobulin heavy chain variable region; VH2 is a second immunoglobulin heavy chain variable region; VH3 is a third immunoglobulin heavy chain variable region; VH4 is a fourth immunoglobulin heavy chain variable region; VH5 is a fifth immunoglobulin heavy chain variable region; VH6 is a sixth immunoglobulin heavy chain variable region; Fc is a region comprising an immunoglobulin heavy chain constant region 2 (CH2), an immunoglobulin heavy chain constant region 3 (CH3), and optionally, an immunoglobulin hinge; CH1 is a heavy chain constant region 1; CL is a light chain constant region; and L1, L2, L3, L4, L5, L6, L7, L8, L9, L10, L11, L12 and L13 are amino acid linkers.

Also provided herein is an antigen binding polypeptide or antigen binding polypeptide complex that specifically binds to a viral peptide or an HIV protein.

Also provided herein is an antibody or antigen binding fragment thereof comprising an antigen binding polypeptide or antigen binding polypeptide described herein.

Also provided herein is a polypeptide having at least 90% identity, at least 95% identity, or 100% identity to any one of SEQ ID NOs:30-46, 94 and 96. Provided herein is a polypeptide encoded by a polynucleotide having at least 90% identity, at least 95% identity, or 100% identity to any one of SEQ ID NOs:47-63, 95 and 97.

Also provided herein is a polynucleotide encoding an antigen binding polypeptide or antigen binding polypeptide complex described herein. Provided herein is a polynucleotide having at least 90% identity, at least 95% identity, or 100% identity to any one of SEQ ID NOs:47-63, 95 and 97. Also provided herein is a polynucleotide encoding a polypeptide having at least 90% identity, at least 95% identity, or 100% identity to any one of SEQ ID NOs:30-46, 94 and 96.

Also provided herein is a vector comprising a polynucleotide described herein.

Also provided herein is a host cell comprising a polynucleotide or vector described herein.

Also provided herein is a chimeric antigen receptor (CAR) comprising an antigen binding polypeptide or antigen binding polypeptide complex described herein.

Also provided herein is an immune cell comprising a CAR described herein.

Also provided herein is a pharmaceutical composition comprising (i) an antigen binding polypeptide or antigen binding polypeptide complex, antibody or antigen binding fragment thereof, polypeptide, polynucleotide, vector, host cell, CAR, immune cell, or a combination thereof, and (ii) a pharmaceutically acceptable carrier.

Also provided herein is a kit comprising an antigen binding polypeptide or antigen binding polypeptide complex, antibody or antigen binding fragment thereof, polypeptide, polynucleotide, vector, host cell, CAR, immune cell, or a combination thereof.

Also provided herein are certain methods of use of an antigen binding polypeptide, antigen binding polypeptide complex, antibody or antigen binding fragment thereof, polypeptide, polynucleotide, vector, host cell, CAR or immune cell described herein, or a combination thereof.

BRIEF DESCRIPTION OF THE DRAWINGS

Some aspects of the invention are herein described, by way of example only, with reference to the accompanying drawings. With specific reference now to the drawings in detail, it is stressed that the particulars shown are by way of example and for purposes of illustrative discussion of aspects of the invention.

Figure 1A:
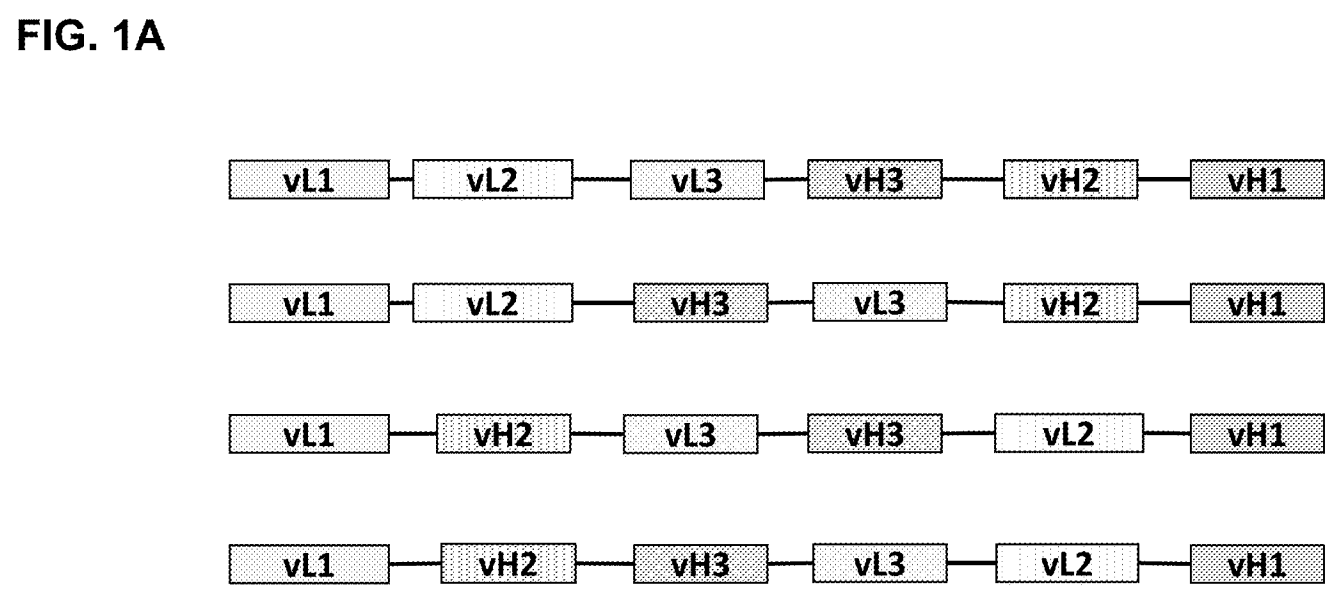

FIGS. 1A-1E show non-limiting examples of different configurations of single chain trispecific antibody molecules. FIG. 1A: trispecific configurations without Fc. FIG. 1B: trispecific configuration with single chain Fc. FIG. 1C: trispecific configuration with single chain CH3. FIG. 1D: trispecific hexavalent configurations. FIG. 1E: trispecific configuration on one arm heterodimerizing with Fc. As used in FIGS. 1A-1E, vL1 is a first immunoglobulin light chain variable region. vL2 is a second immunoglobulin light chain variable region. vL3 is a third immunoglobulin light chain variable region. vH1 is a first immunoglobulin heavy chain variable region. vH2 is a second immunoglobulin heavy chain variable region. vH3 is a third immunoglobulin heavy chain variable region. CH2 is an immunoglobulin heavy chain constant region 2. CH3 is an immunoglobulin heavy chain constant region 3. In FIG. 1E, the circle symbol in the CH3 region is a knob-into-hole modification.

FIGS. 2A-2C show ELISA results of trispecific aCD28aCD3LHaCD38 LALAPAFc and respective positive controls, aCD28aCD3/aCD38Fab, or isotype control (Control IgG) binding to CD3 (FIG. 2A), CD28 (FIG. 2B), and CD38 (FIG. 2C). Molecule structures are depicted in FIG. 1A.

FIGS. 4A-4B show NFκB (FIG. 4A) and nuclear factor of activated T-cells (NFAT) (FIG. 4B) pathway activation by trispecific aCD28aCD3LHaCD38 LALAPAFc, aCD3LHaCD28aCD38 LALAPAFc, aCD3LHaCD38aCD28 LALAPAFc, aCD28aCD3HLaCD38 LALAPAFc, isotype control (Control IgG), or anti-CD3 and anti-CD28 mAbs using NFκB or NFAT promoter-luciferase expressing human Jurkat T cells. Molecule structures are depicted in FIG. 1E.

FIGS. 10A-10F show biolayer interferometry (BLI) binding of hexaspecific aCD3aCD28LHaCD38/aCD33aCD123LHaBCMA antibody at 80 nM to CD3 (FIG. 10A), CD28 (FIG. 10B), CD38 (FIG. 10C), CD33 (FIG. 10D), CD123 (FIG. 10E), and BCMA (FIG. 10F). Molecule structure is depicted in FIG. 9

FIGS. 11A-11F show biolayer interferometry (BLI) binding of hexaspecific aCD3aCD28LHaCD38/aCD123aBCMALHaCD33 antibody at 40 nM to CD3 (FIG. 11A), CD28 (FIG. 11B), CD38 (FIG. 11C), CD33 (FIG. 11D), CD123 (FIG. 11E), and BCMA (FIG. 11F). Molecule structure is depicted in FIG. 9.

FIGS. 12A, 12D and 12F: bispecific molecules without Fc region. FIGS. 12B and 12F: bispecific, tetravalent molecule with Fc region. FIGS. 12C, 12E and 12F: bispecific molecules with Fc region. As used in FIGS. 12A-12F, VL1 refers to a first immunoglobulin light chain variable region, VL2 refers to a second immunoglobulin light chain variable region, VH1 refers to a first immunoglobulin heavy chain variable region, and VH2 refers to a second immunoglobulin heavy chain variable region. In FIGS. 12B, 12C and 12F, CH2 refers to an immunoglobulin heavy chain constant region 2, and CH3 refers to an immunoglobulin heavy chain constant region 3. In FIGS. 12A and 12F, IL12 and 13 refer to amino acid linkers. In FIG. 12D, L1, L2 and L3 refer to amino acid linkers. In FIGS. 12C and 12F, the circle symbol refers to a knob-into-hole modification.

FIG. 23 shows both orientation and linker can affect expression of tetraspecific molecules.

FIGS. 26A-26D show ELISA results of tetraspecific aCD28aCD3CD38CD19LALAPAFc, aCD28aCD3CD38CD19LALAPAFc, aCD28aCD3CD38CD19LALAPAFc, or aCD3aCD28CD19CD38LALAPAFc, or isotype control (Control IgG) binding to CD3 (FIG. 26A), CD28 (FIG. 26B), CD38 (FIG. 26C), and CD19 (FIG. 26D). Molecule structures are depicted in FIG. 19C.

FIGS. 27A-27D show configurations of exemplary bispecific molecules of the invention. VL1 refers to a first immunoglobulin light chain variable region. VL2 refers to a second immunoglobulin light chain variable region. VL3 refers to a third immunoglobulin light chain variable region. VL4 refers to a fourth immunoglobulin light chain variable region. VH1 refers to a first immunoglobulin heavy chain variable region. VH2 refers to a second immunoglobulin heavy chain variable region. VH3 refers to a third immunoglobulin heavy chain variable region. VH4 refers to a fourth immunoglobulin heavy chain variable region. CH3 refers to an immunoglobulin heavy chain constant region 3.

Figures 28A, 28B, 28C:
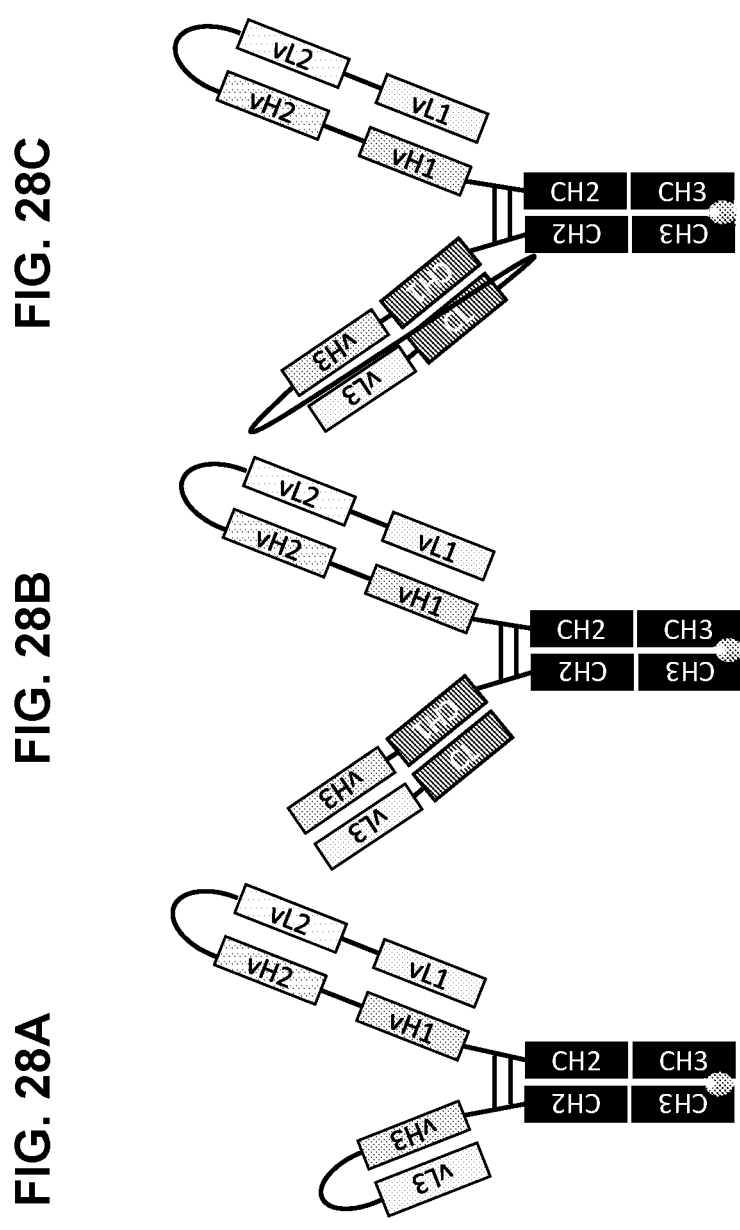
Figures 28D, 28E:
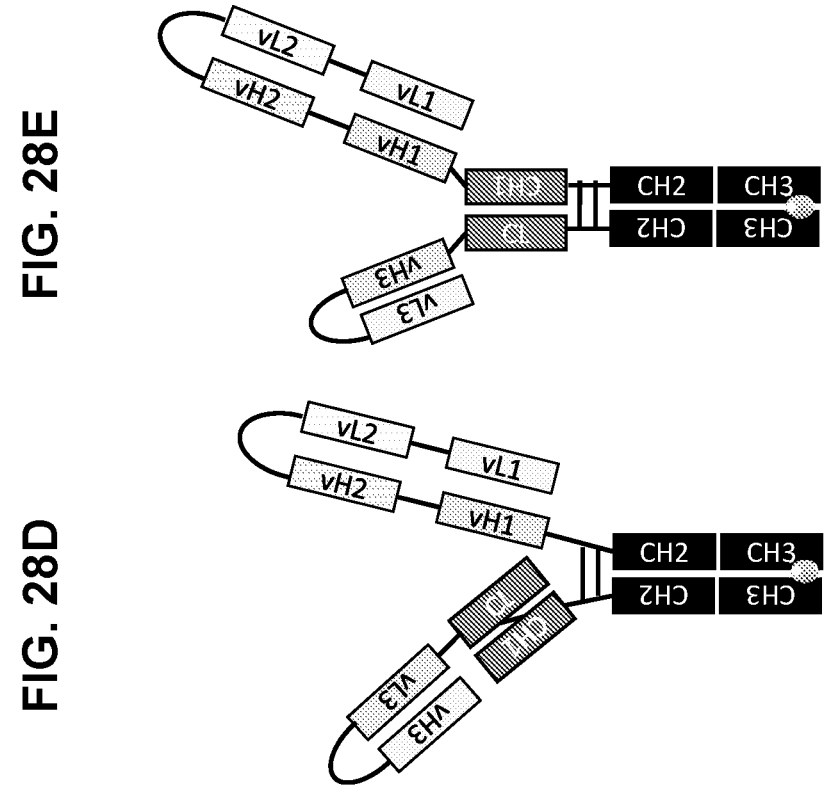

FIGS. 28A-28E show exemplary configurations of trispecific antibody molecules. FIG. 28A: bispecific arm paired with scFv-Fc. FIG. 28B: bispecific arm paired with Fab-Fc. FIG. 28C: bispecific arm paired with single-chain Fab (scFab). FIG. 28D: bispecific arm paired with scFv-single chain CL-CH1-Fc. FIG. 28E: bispecific arm fused to CH1 and paired with scFv-CL-Fc.

Figure 29A:
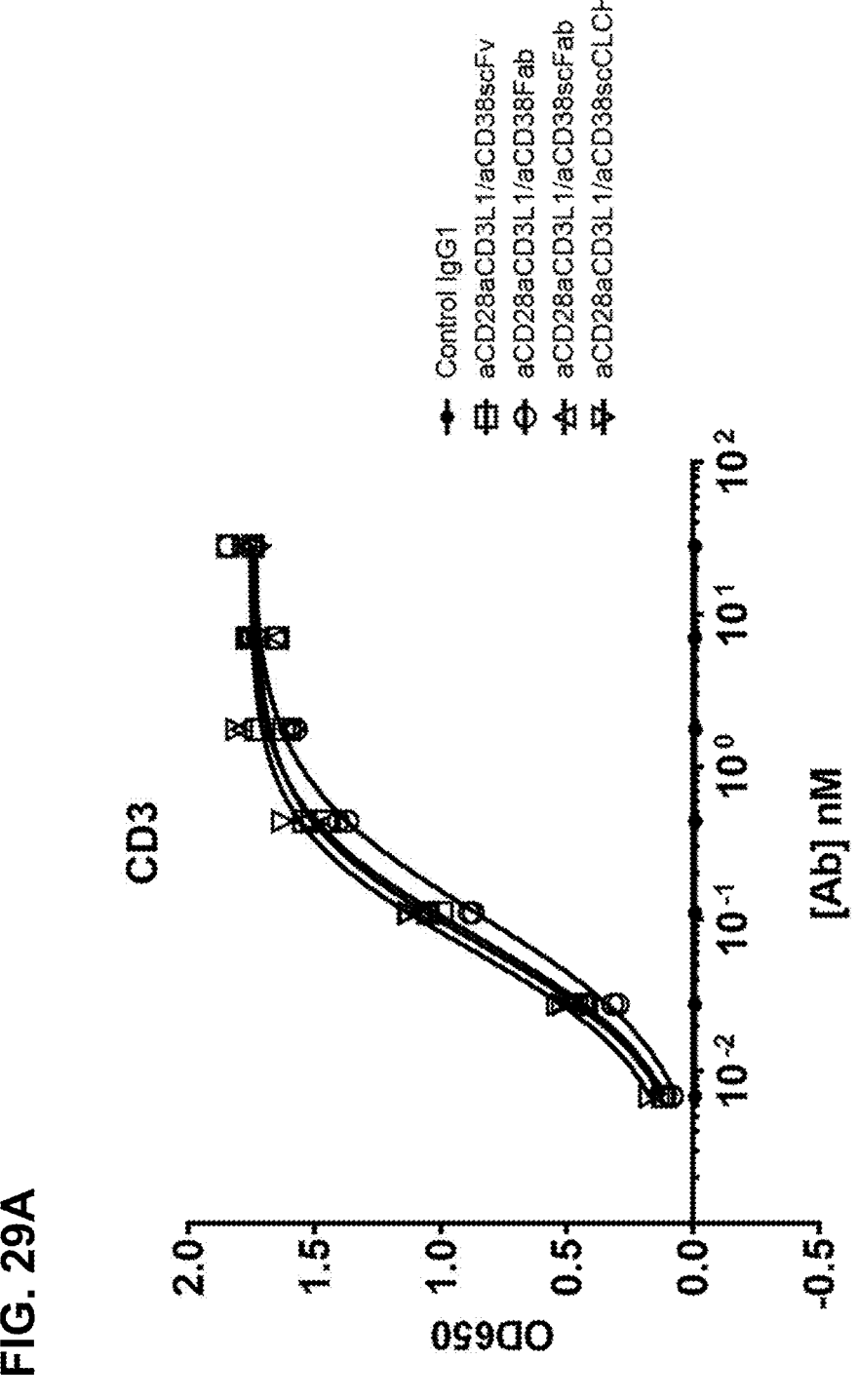
Figure 29B:
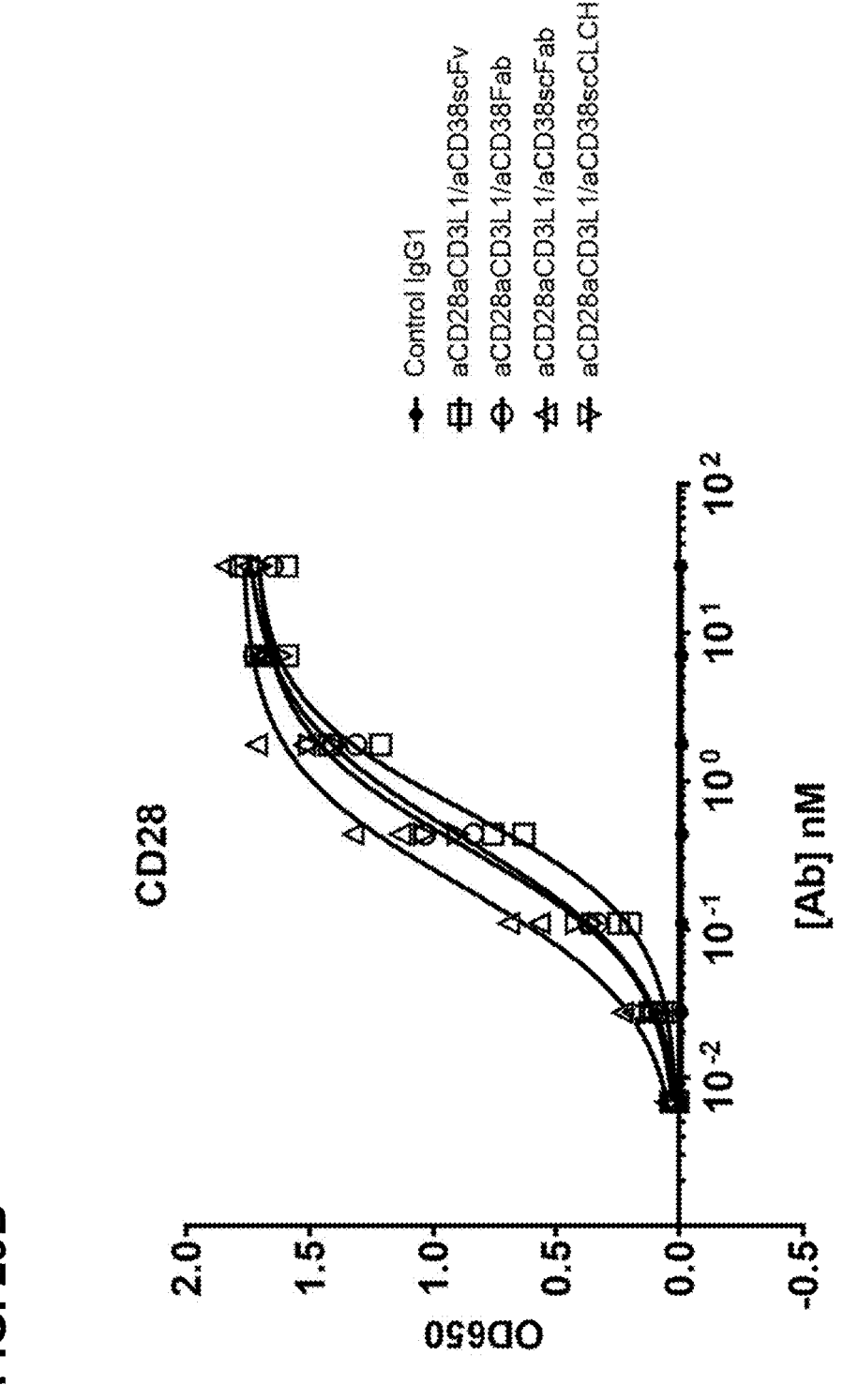
Figure 29C:
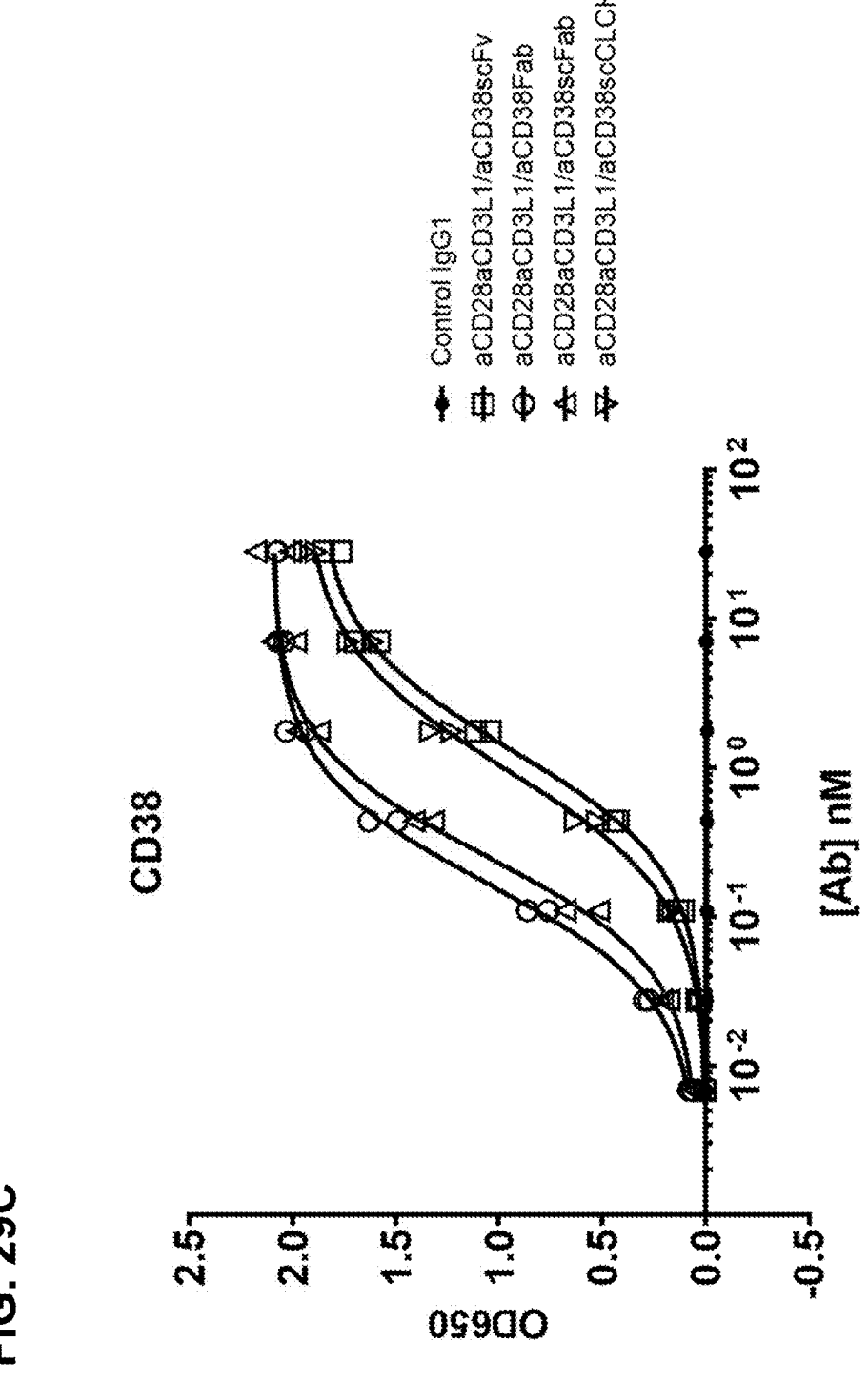

FIGS. 29A-29C show ELISA results of trispecific aCD28aCD3/aCD38scFv, aCD28aCD3/aCD38Fab, aCD28aCD3/aCD38scFab, aCD28aCD3/aCD38CLCH1, or isotype control (Control IgG) binding to CD3 (FIG. 29A), CD28 (FIG. 29B), and CD38 (FIG. 29C). Molecule structures are depicted in FIGS. 28A-28D.

Figure 30:
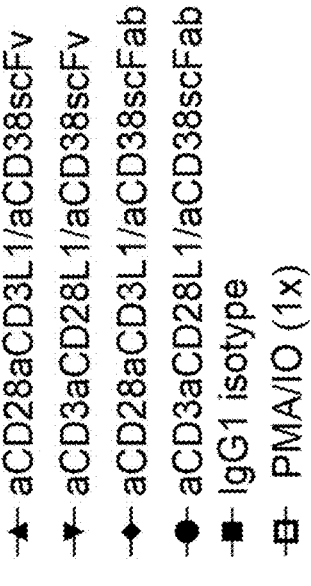
Figure 30:
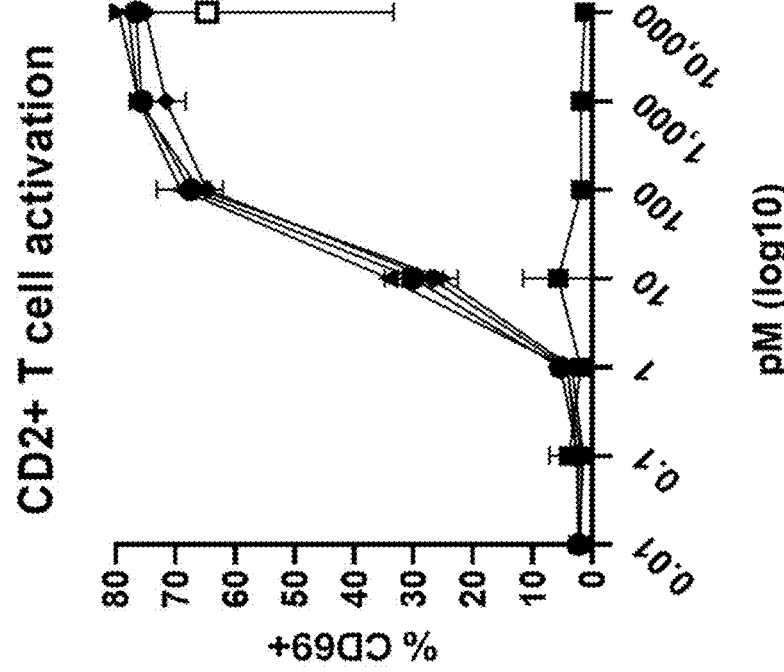

FIG. 30 shows the activation (CD69+) by trispecific antibodies aCD28aCD3L1/aCD38scFv, aCD3aCD28/aCD38scFv, aCD28aCD3/aCD38scFab, aCD3aCD28/aCD38scFab, PMA/IO positive or negative isotype (Control IgG) control, of CD2+ T cells from three different donors.

Figures 31A, 31B:
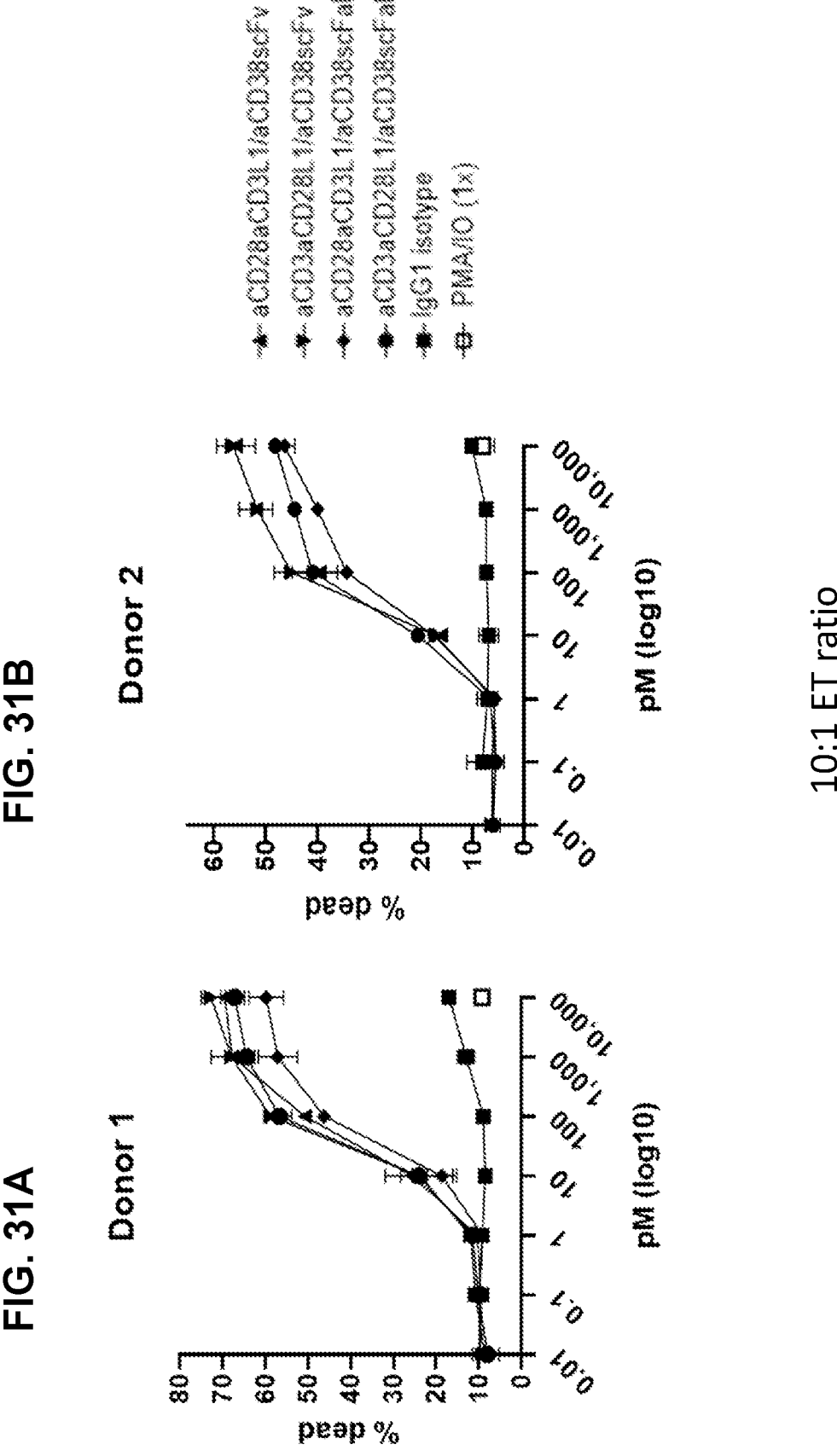
Figure 31C:
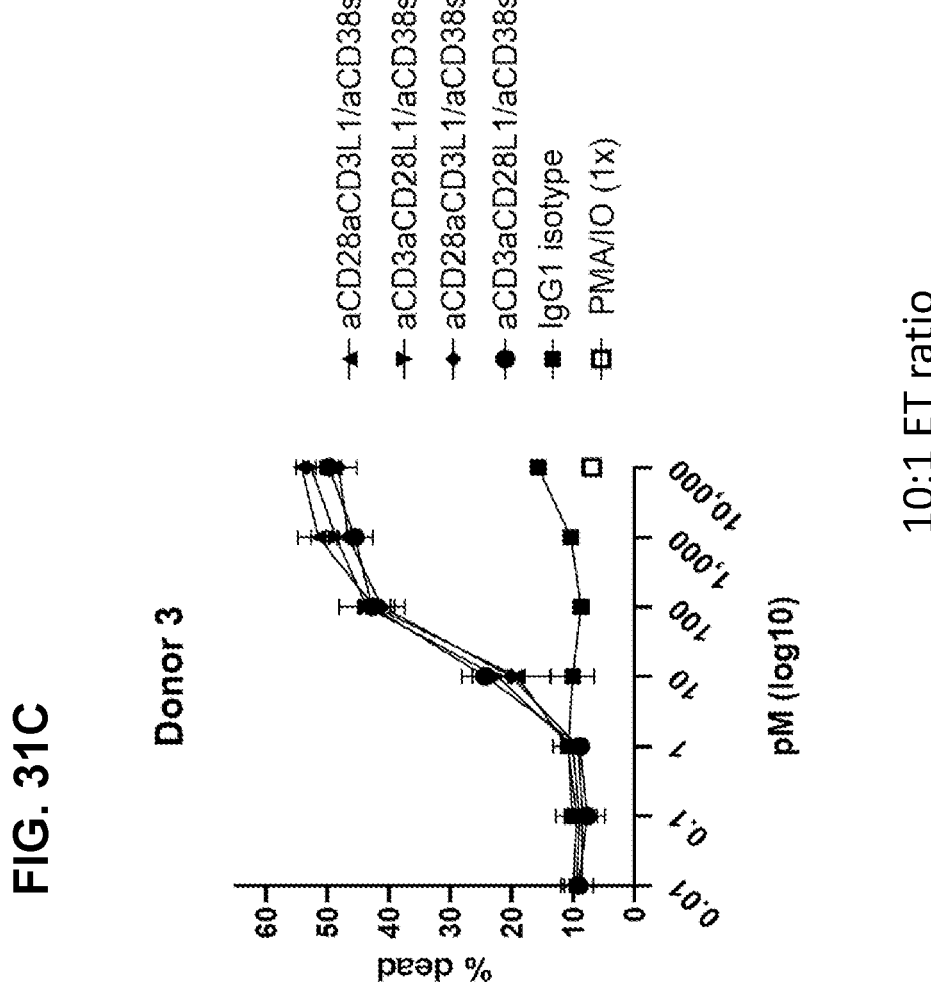

FIGS. 31A-31C show in vitro cytolysis of lymphoma tumor cells Z-138 by T cells mediated by trispecific antibodies aCD28aCD3L1/aCD38scFv, aCD3 aCD28/aCD38 scFv, aCD28aCD3/aCD38scFab, aCD3aCD28/aCD38scFab, PMA/IO or isotype (Control IgG) control from three different donors (FIGS. 31A-31C, respectively).

Figure 32A:
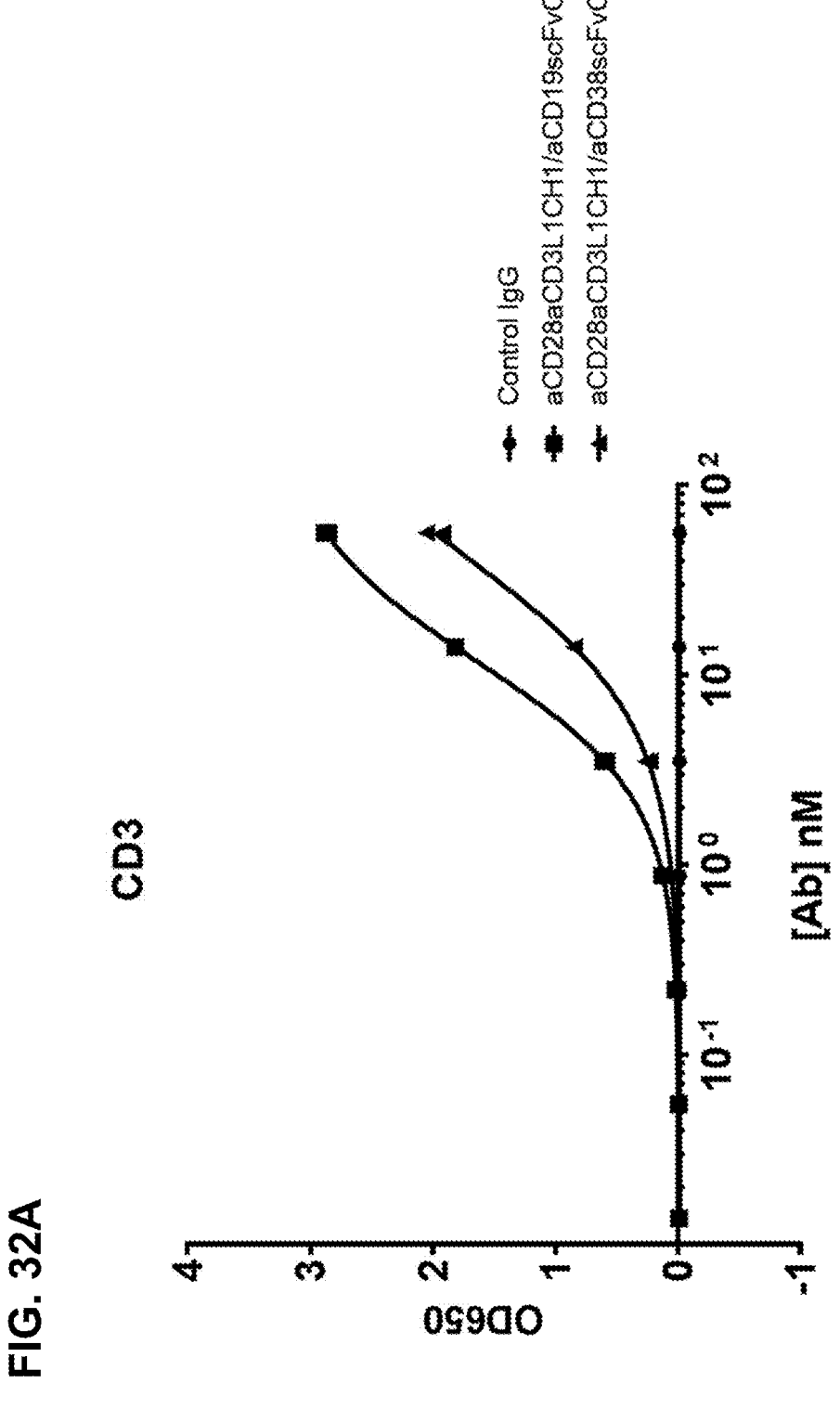
Figure 32B:
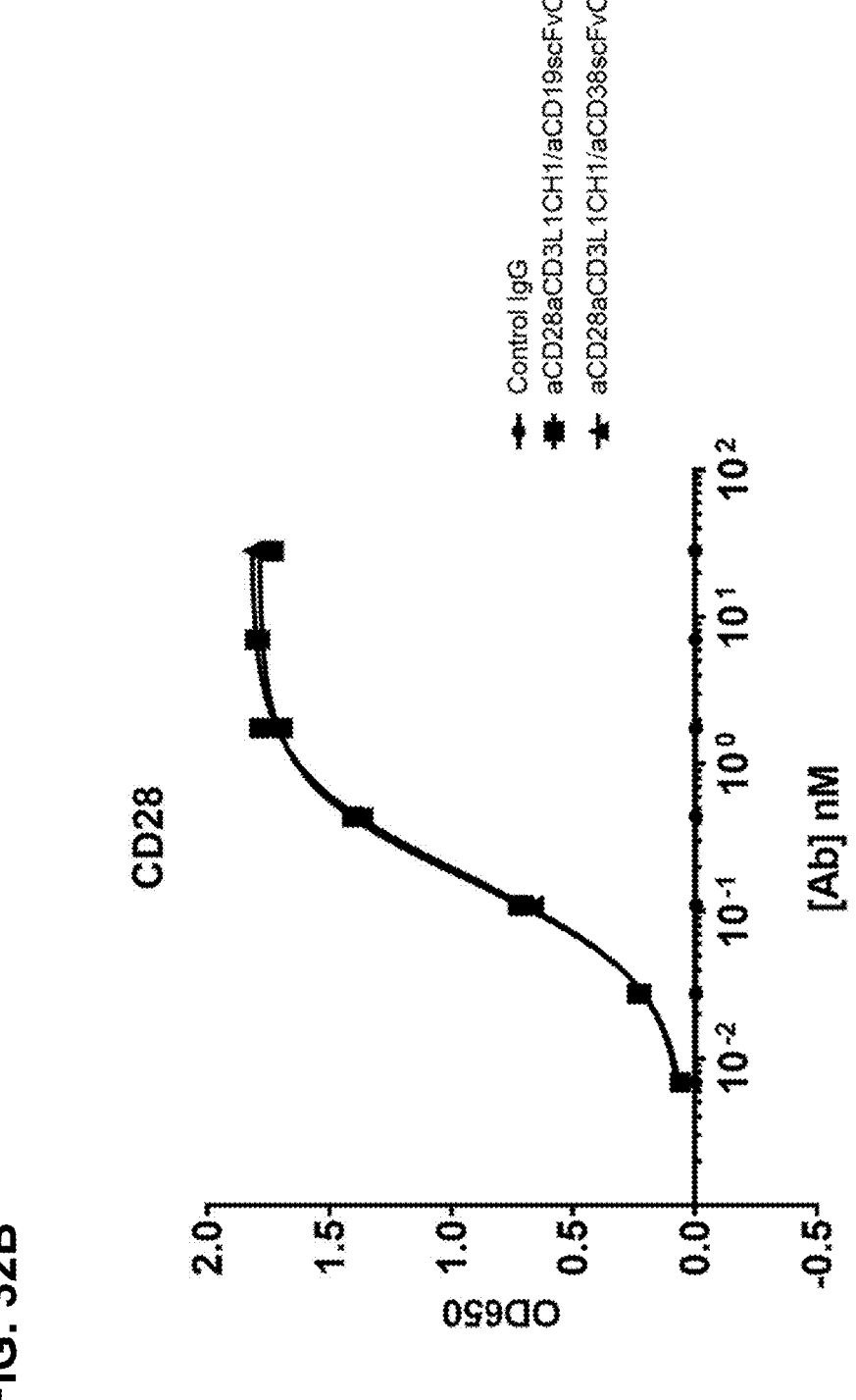
Figure 32C:
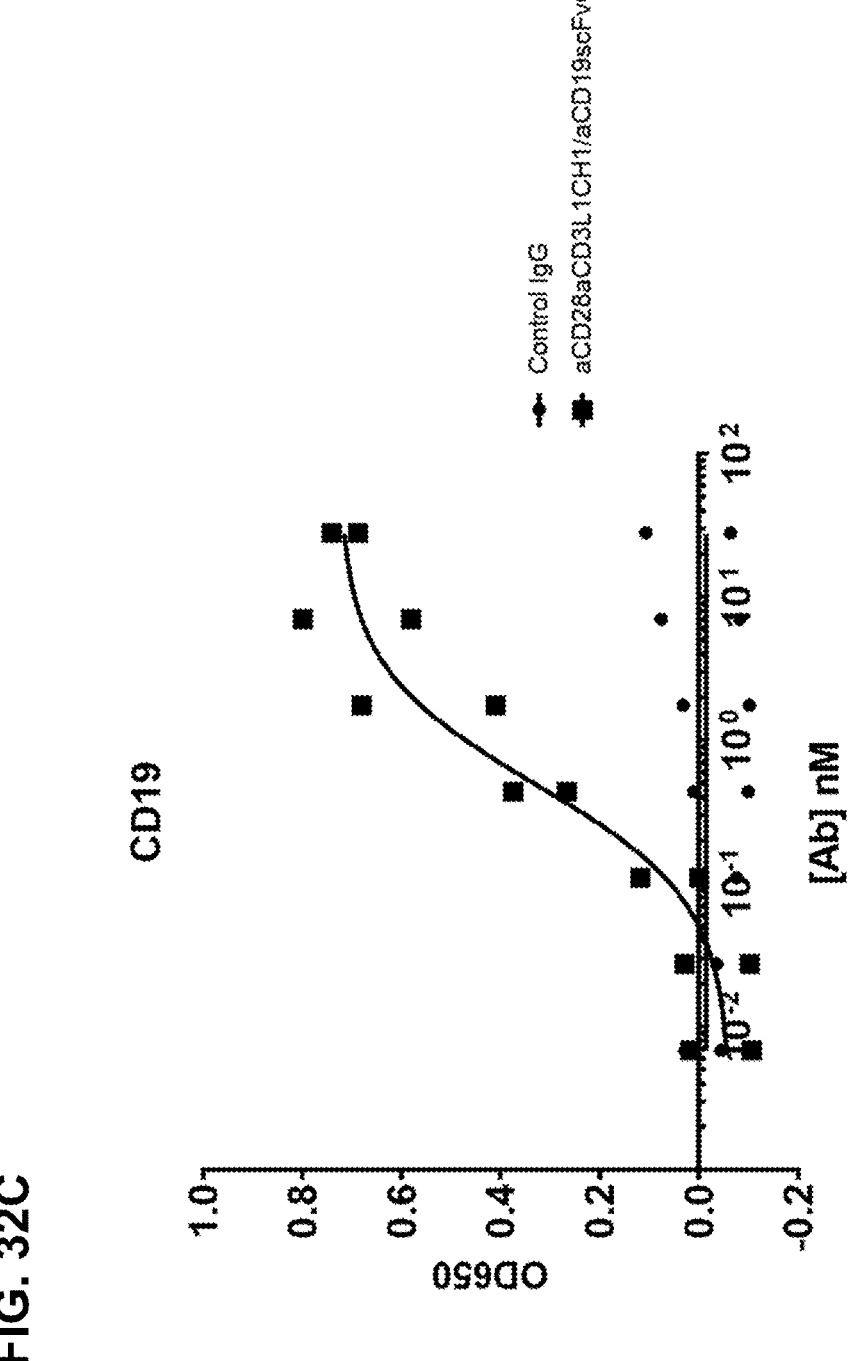
Figure 32D:
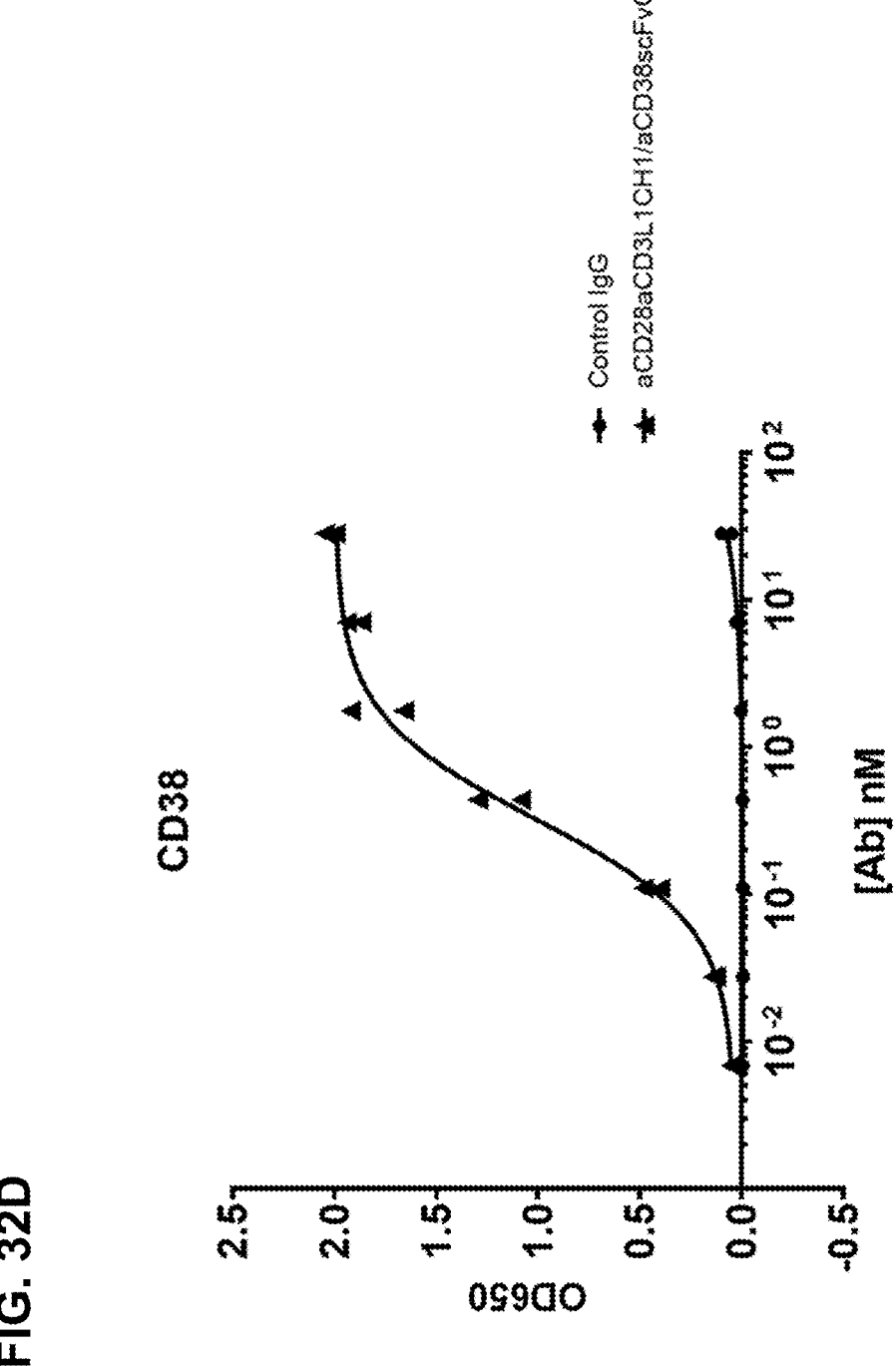

FIGS. 32A-32D show ELISA results of trispecific aCD28aCD3CL1CH1/aCD38scFvCL, aCD28aCD3CL1CH1/aCD19scFvCL, or isotype control (Control IgG) binding to CD3 (FIG. 32A), CD28 (FIG. 32B), CD19 (FIG. 32C), and CD38 (FIG. 32D). Molecule structures are depicted in FIG. 28E.

Figure 33:
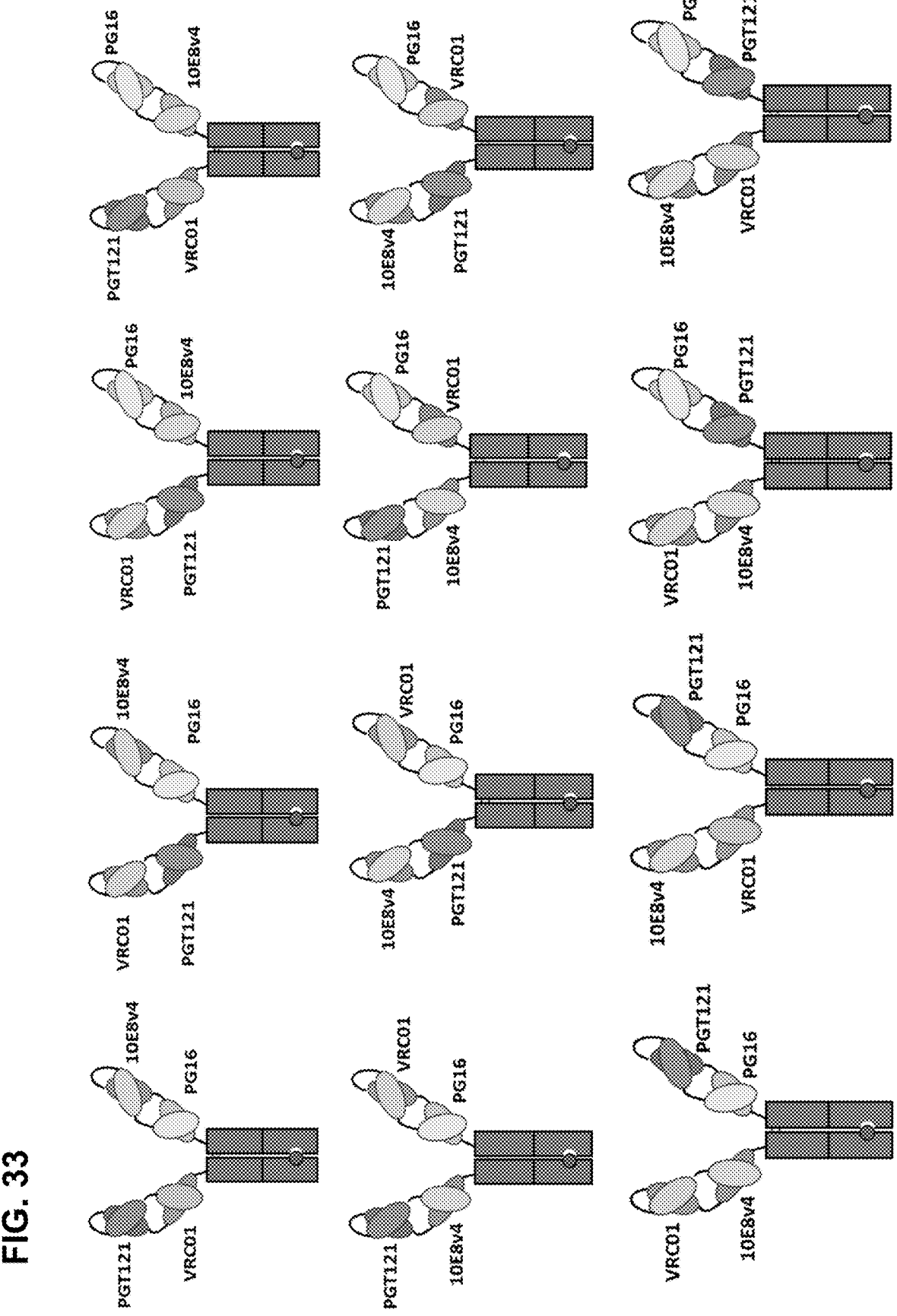

FIG. 33 shows additional non-limiting examples of different configurations of tetraspecific antibody molecules.

Figure 34:
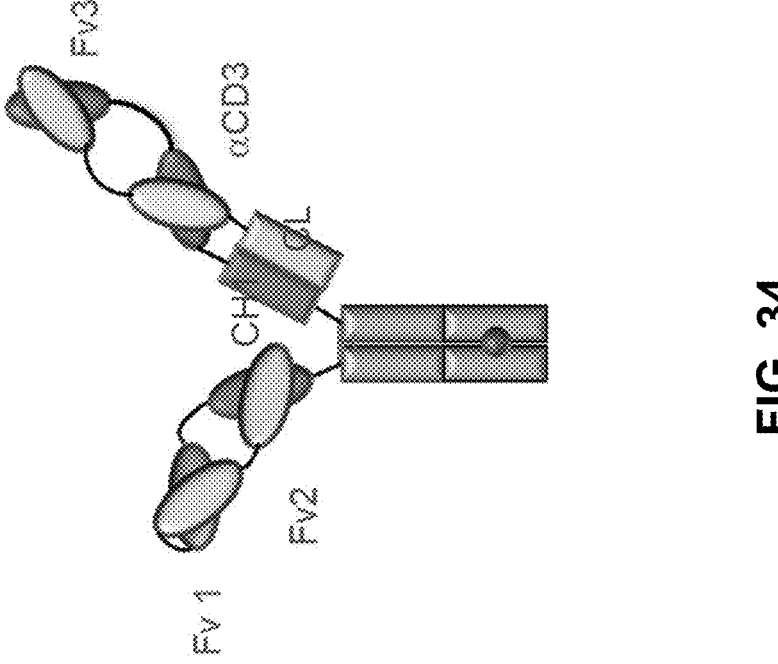

FIG. 34 depicts an exemplary configuration of a masked tetraspecific antibody. Variable domains (Fv) of the antibody are shown as heavy chain/light chain pairs, with Fv1-Fv3 targeting tumor associated antigens (TAAs) or immune costimulatory receptors, and a fourth Fv targeting CD3 (aCD3 or aCD3). In some aspects, linkers between Fv3 and aCD3 contain one or more protease recognition sites.

Figure 35:
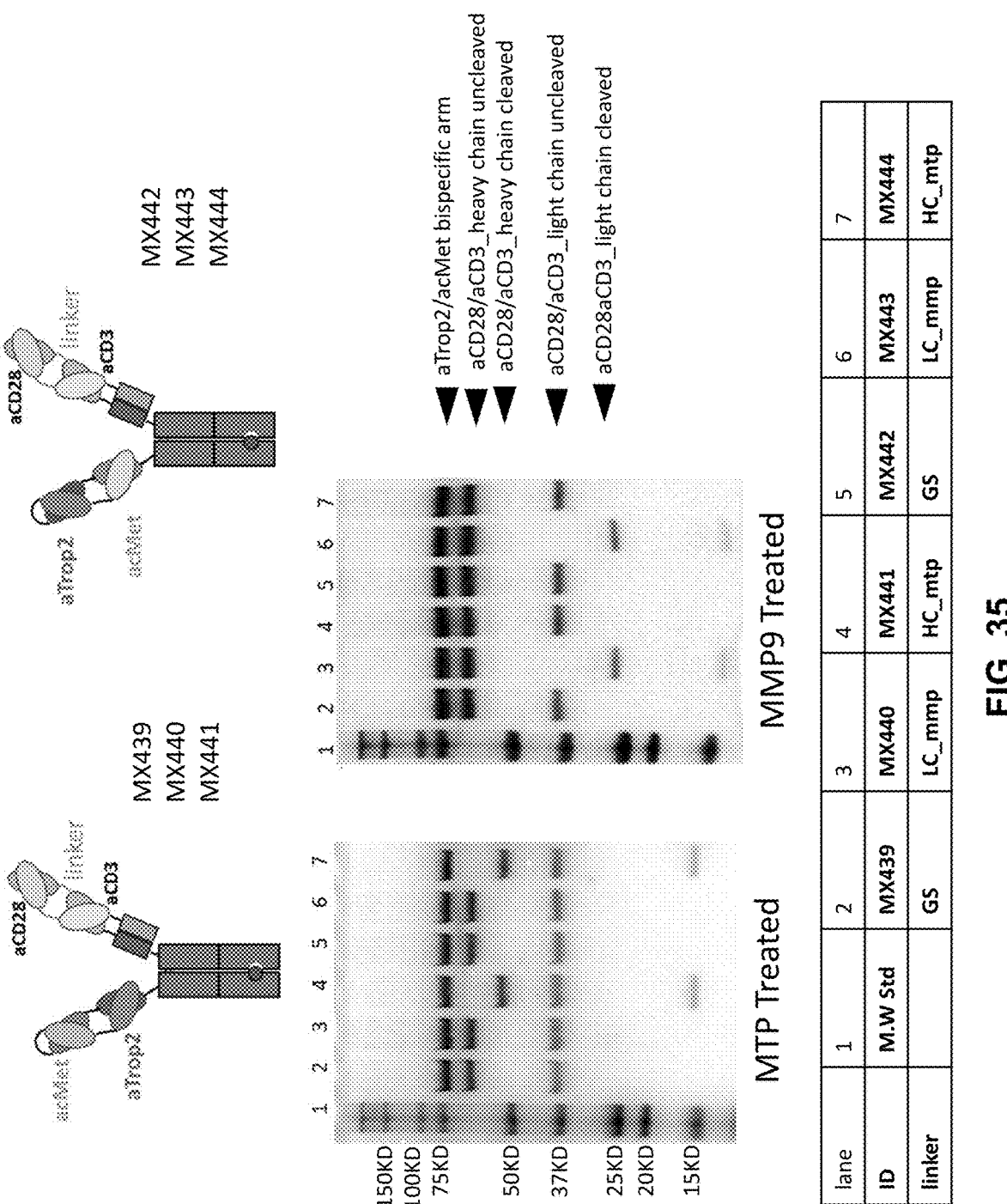
Figures 36A, 36B:
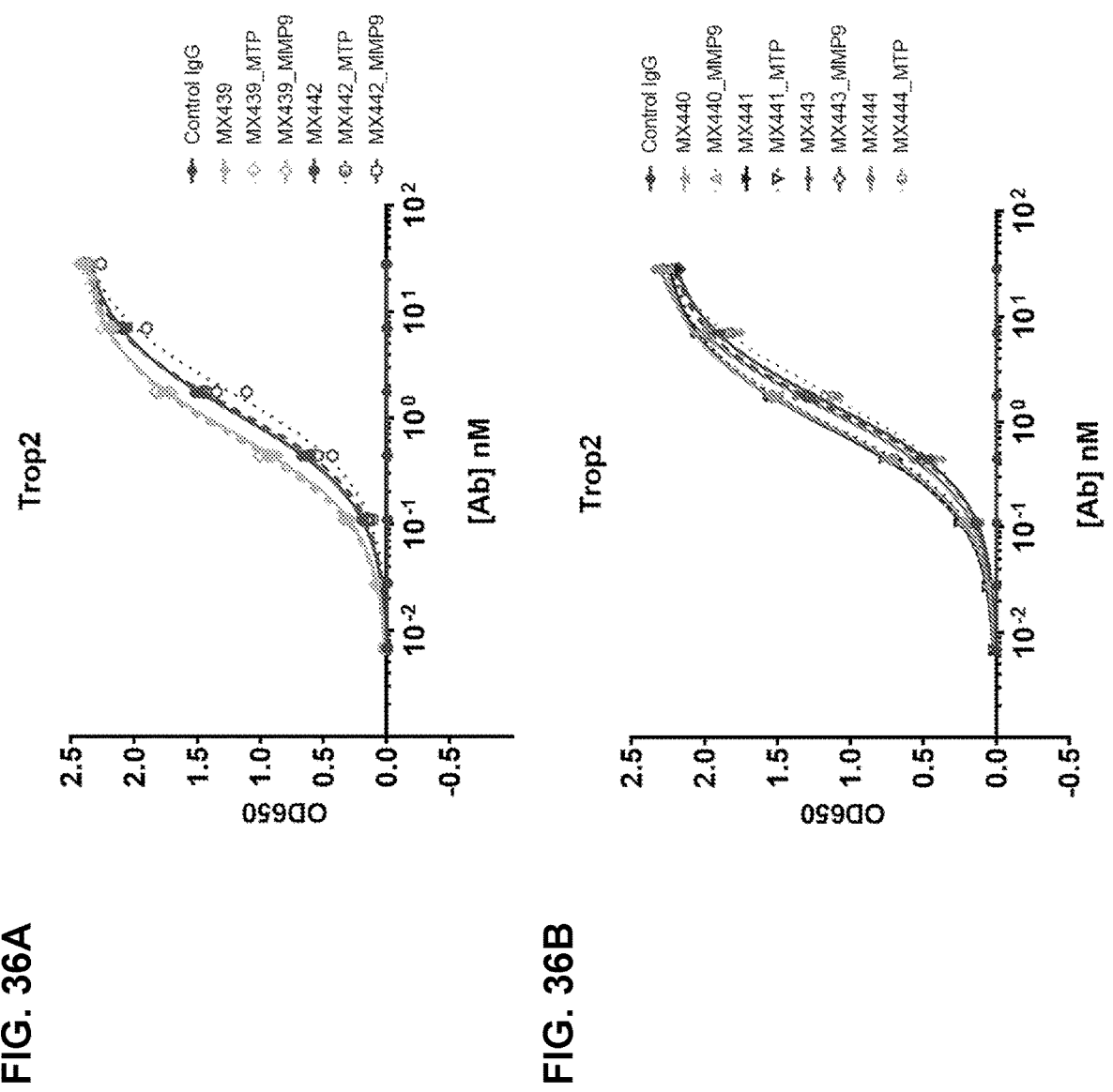
Figures 36C, 36D:
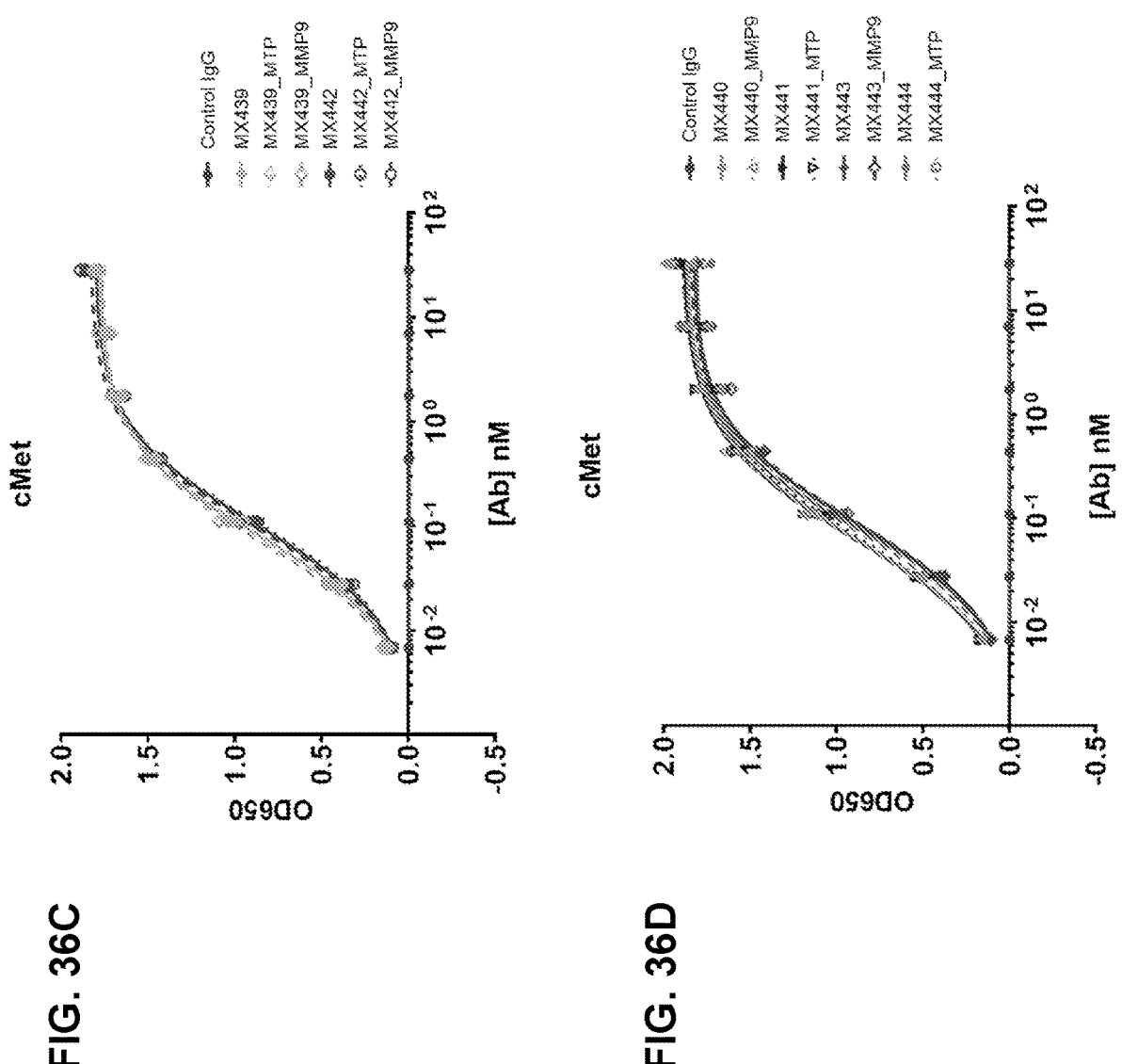

FIG. 35 shows SDS-PAGE results of in vitro cleavage of exemplary masked tetraspecific molecules as depicted. Molecules were treated with either MTP or MMP9 protease as specified.

FIGS. 36A-36D show ELISA binding results of exemplary masked tetraspecific molecules as depicted in FIG. 35, or negative isotype (Control IgG1), with or without protease treatment. Molecules cleaved or not cleaved by MTP or MMP9 as specified were tested for binding affinity to Trop2 and cMet.

Figures 37A, 37B:
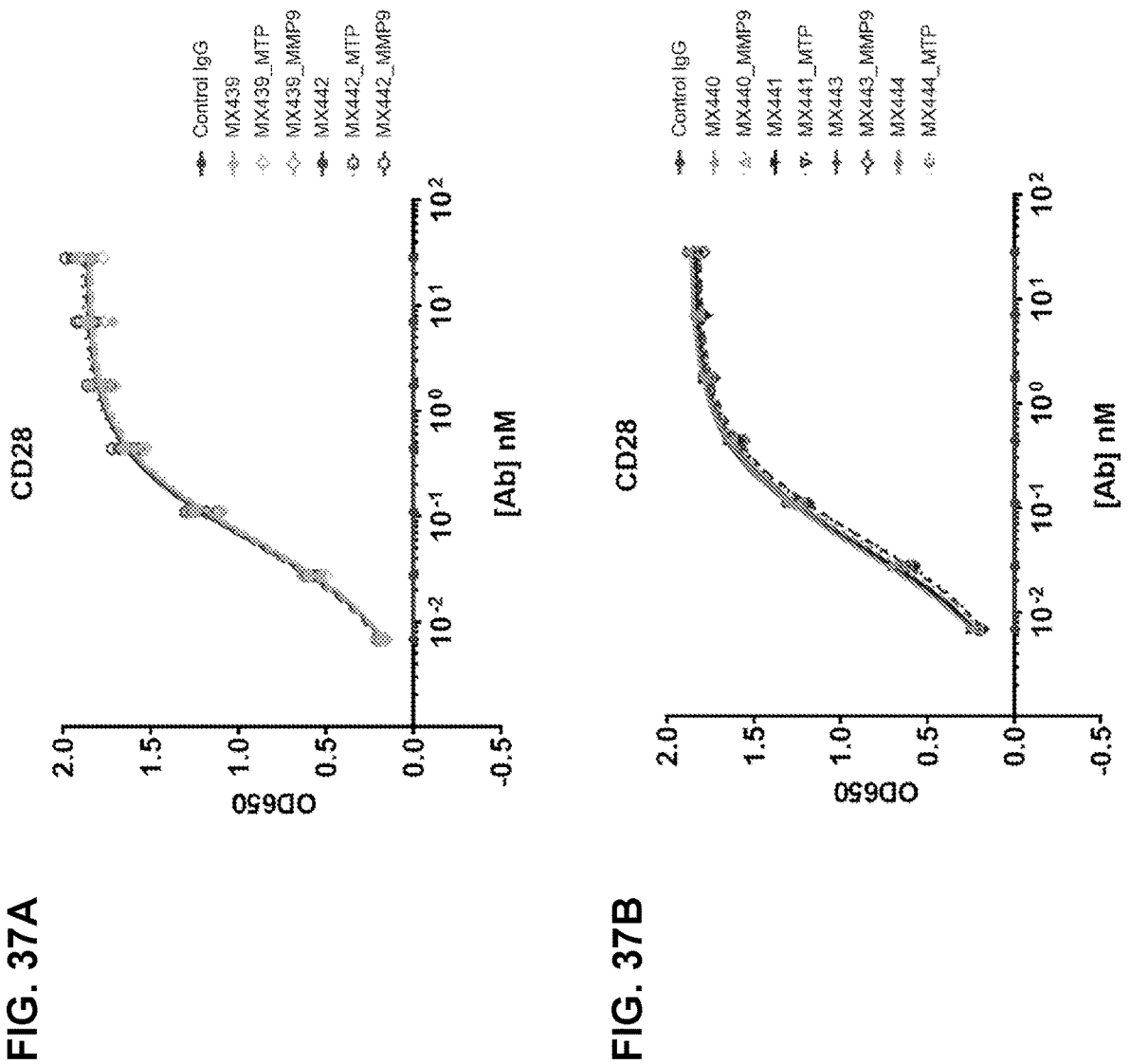
Figures 38A, 38B:
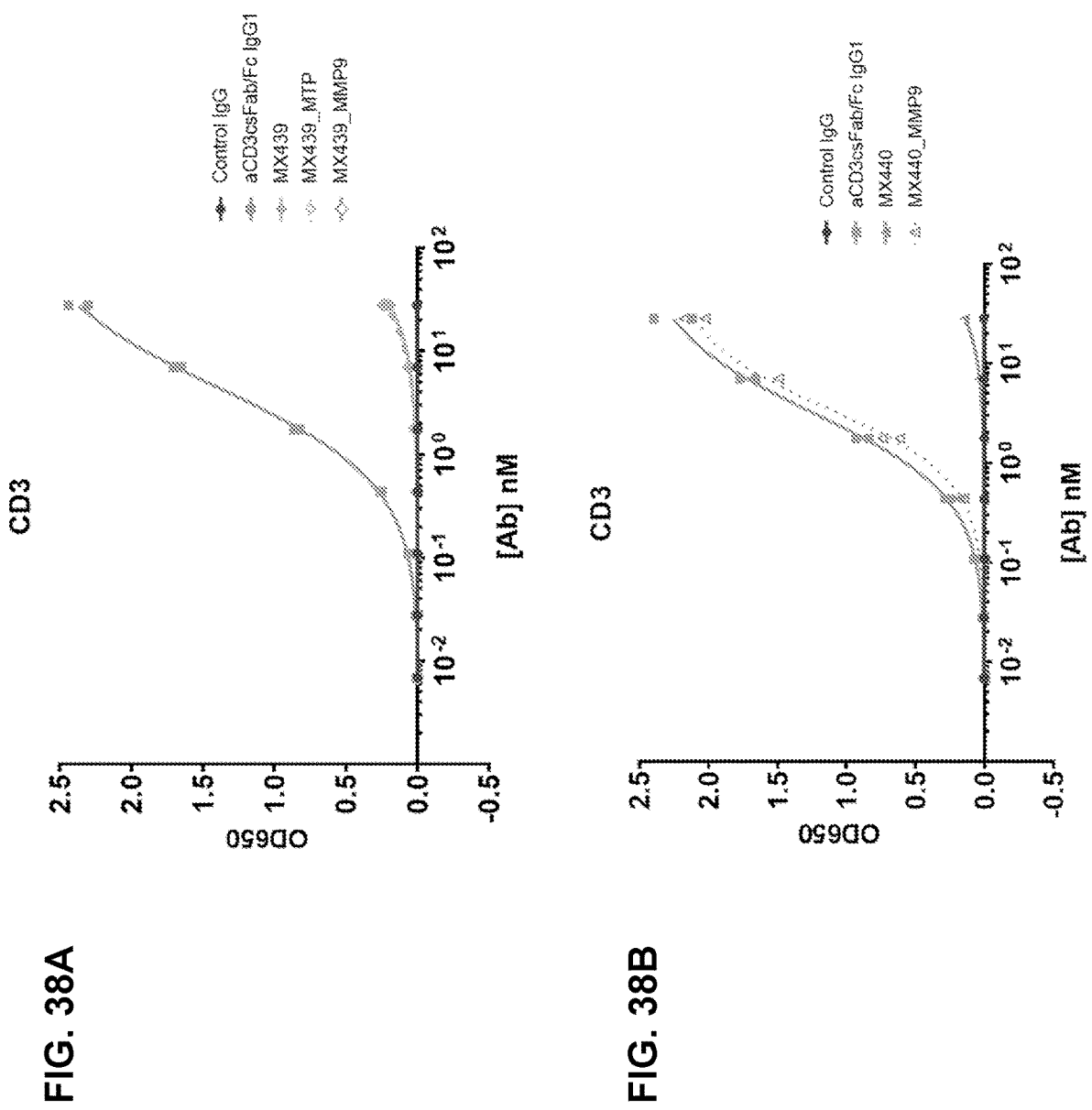
Figures 38C, 38D:
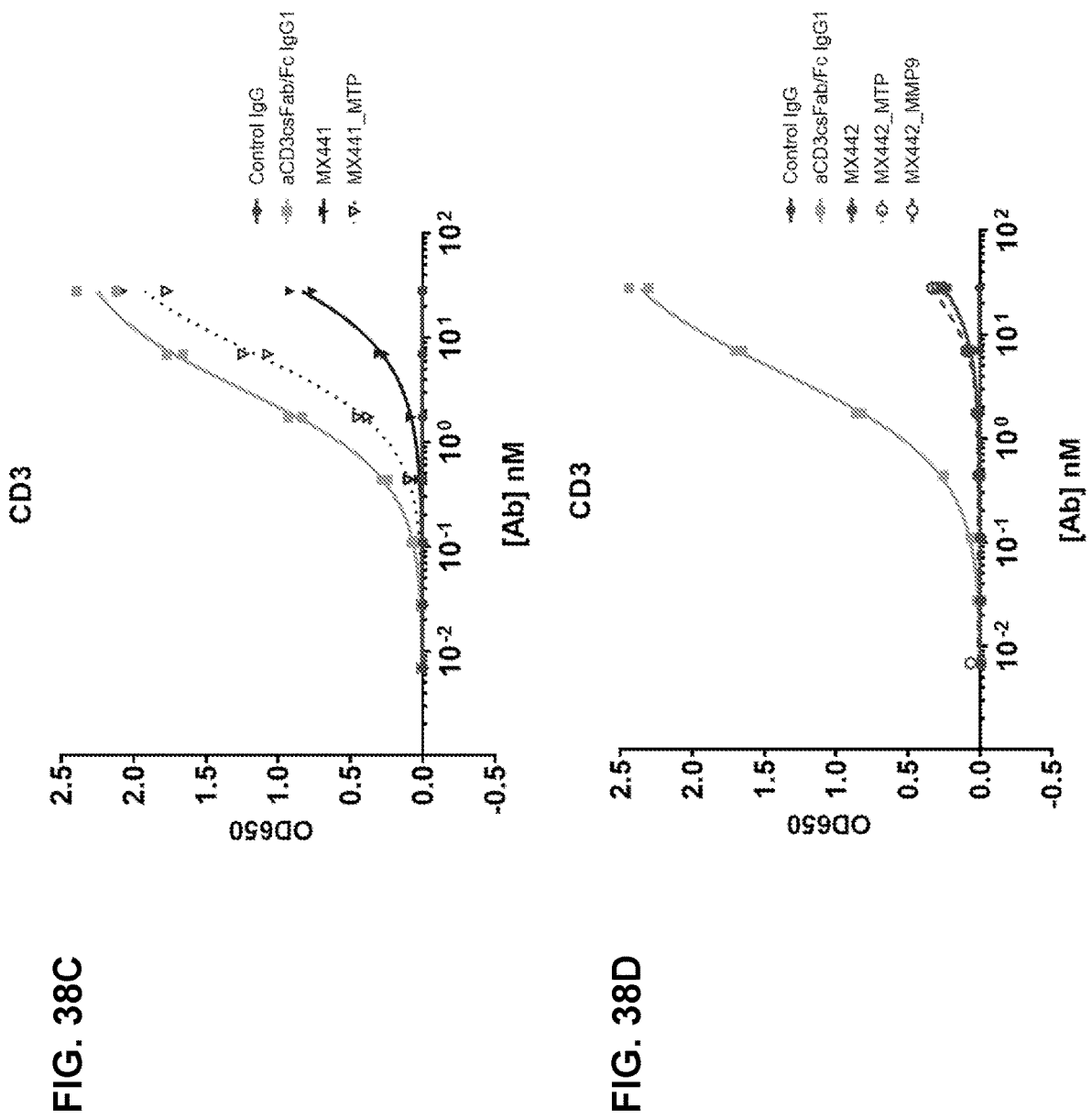
Figures 38E, 38F:
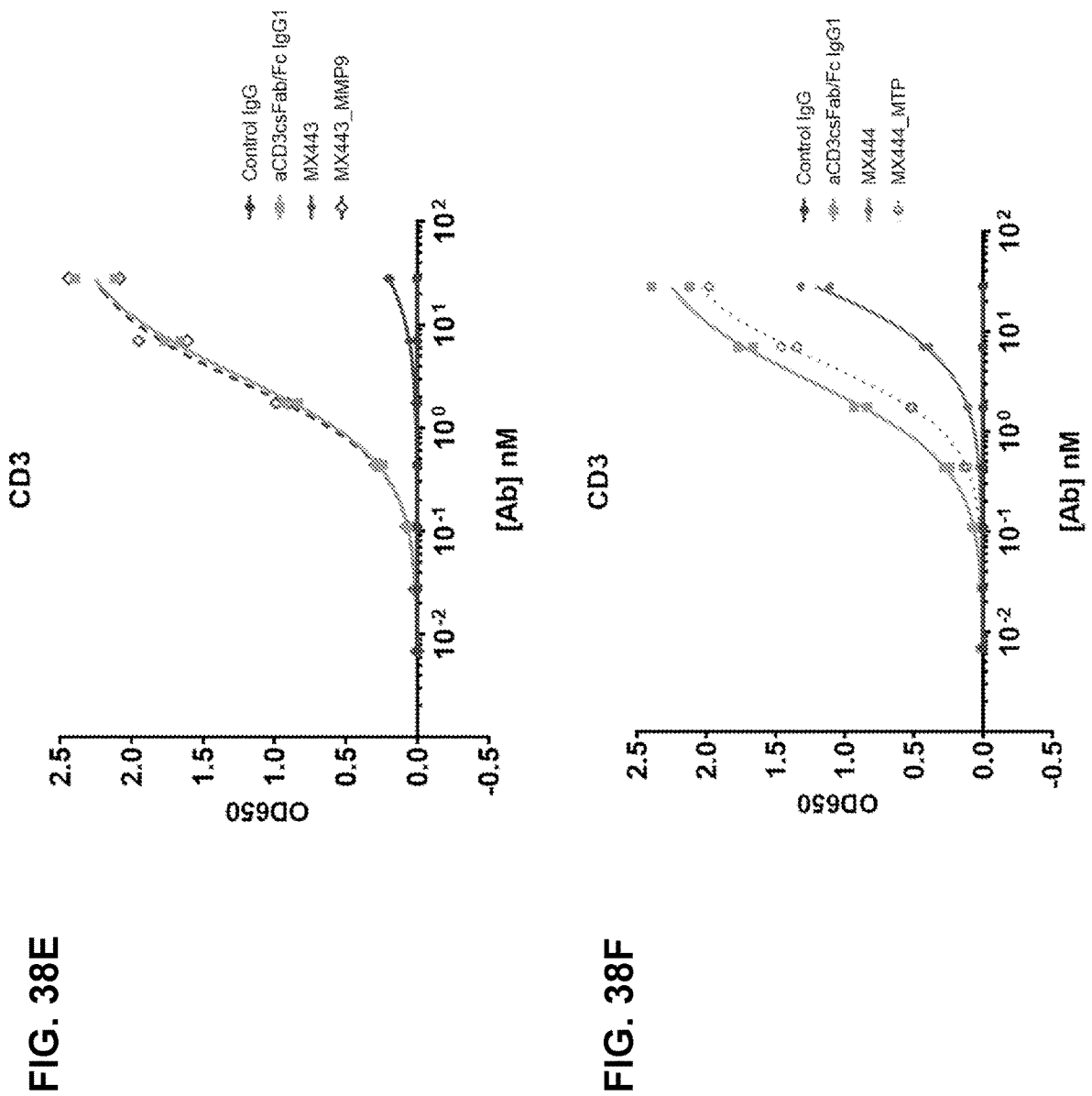

FIGS. 37A-37B show ELISA binding results of exemplary masked tetraspecific molecules as depicted in FIG. 35, or negative isotype (Control IgG1), with or without protease treatment. Molecules cleaved or not cleaved by MTP or MMP9 as specified were tested for binding affinity to CD28.

FIGS. 38A-38F show ELISA binding results of exemplary masked tetraspecific molecules as depicted in FIG. 35, or negative isotype (Control IgG1), with or without protease treatment. Molecules cleaved or not cleaved by MTP or MMP9 as specified were tested for binding affinity to CD3.

Figure 13:
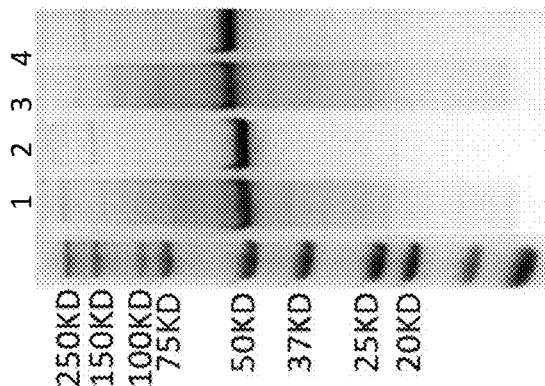
FIG. 13 shows SDS-PAGE results of Nickel-NTA (Ni-NTA)-purified bispecific molecules with histidine tags, as depicted in FIG. 12A.

FIGS. 39A-39B show cytolysis of HCC1954 tumor cells by PBMCs (E:T:10:1) mediated by exemplary masked tetraspecific molecules as depicted in FIG. 13, or negative isotype (Control IgG1), from PBMCs of two donors (KP63250 and KP63251).

Figure 40:
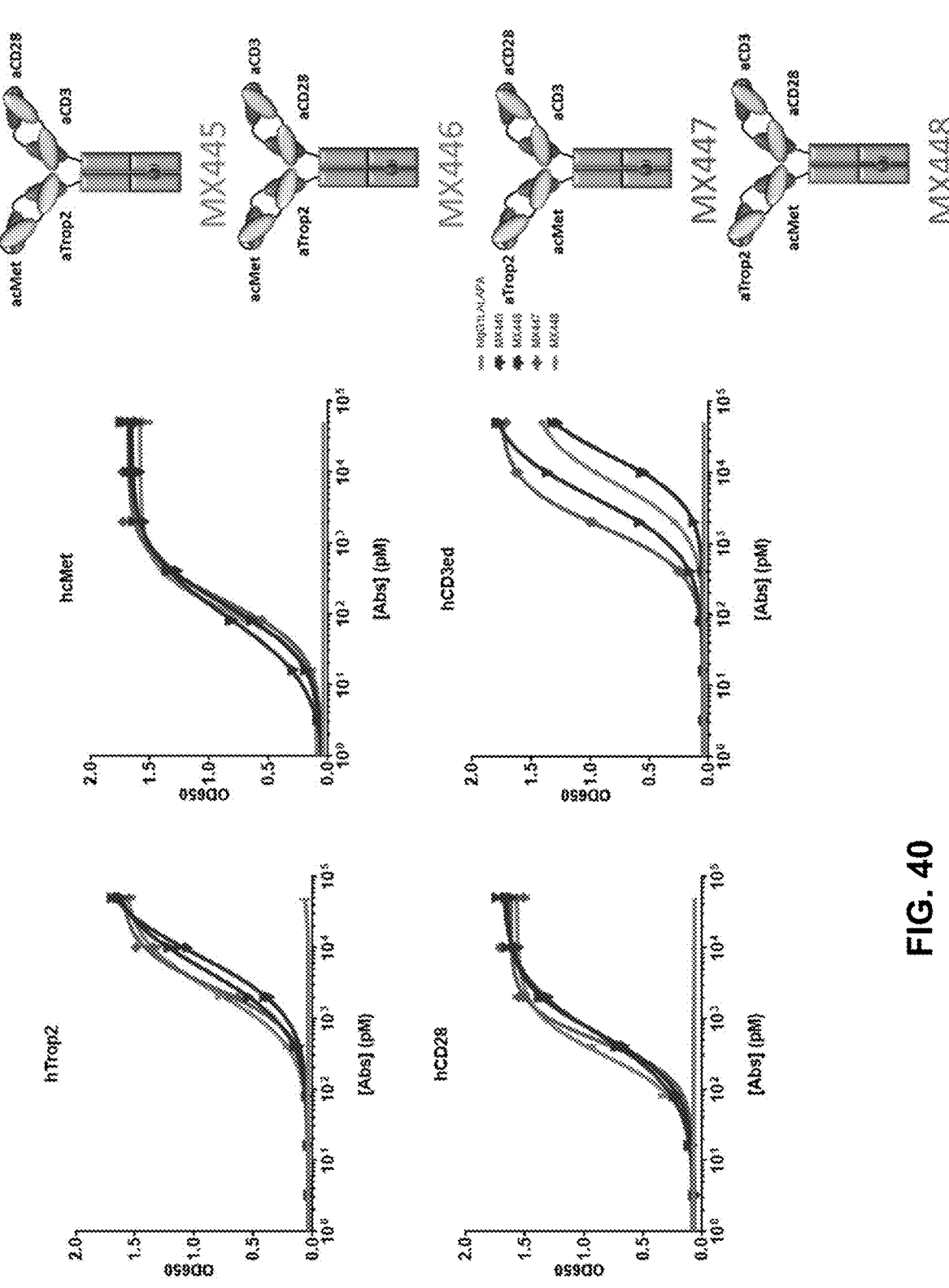

FIG. 40 shows ELISA binding results of exemplary non-masked tetraspecific molecules as depicted, or negative isotype (hIgG1LALPA) control, to their respective targets of hTrop2, hcMet, hCD28, and hCD3.

FIGS. 41A-41B show CD69+ activation by exemplary non-masked tetraspecific molecules, or negative isotype (IgG1LALPA) control, of CD2+ T cells from PBMCs of two different donors.

Figure 42:
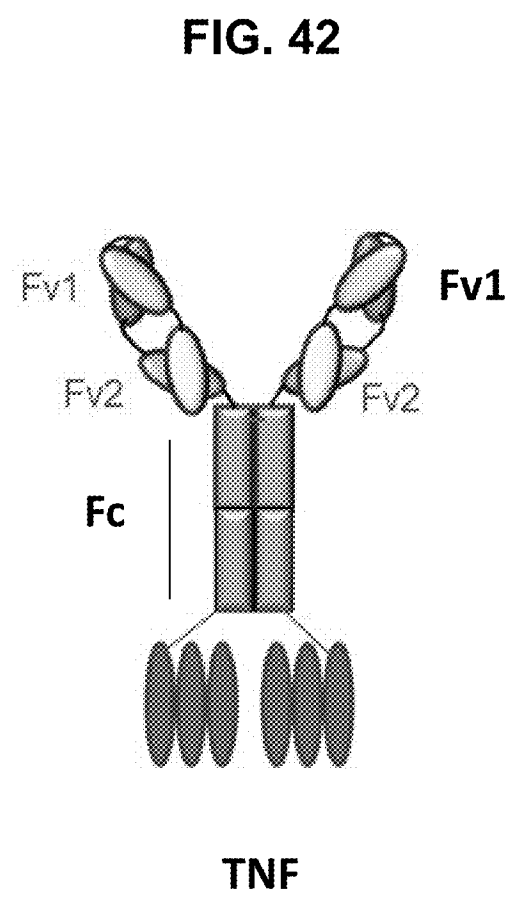

FIG. 42 shows an additional non-limiting example of a tetraspecific antibody molecule.

Figures 43A, 43B:
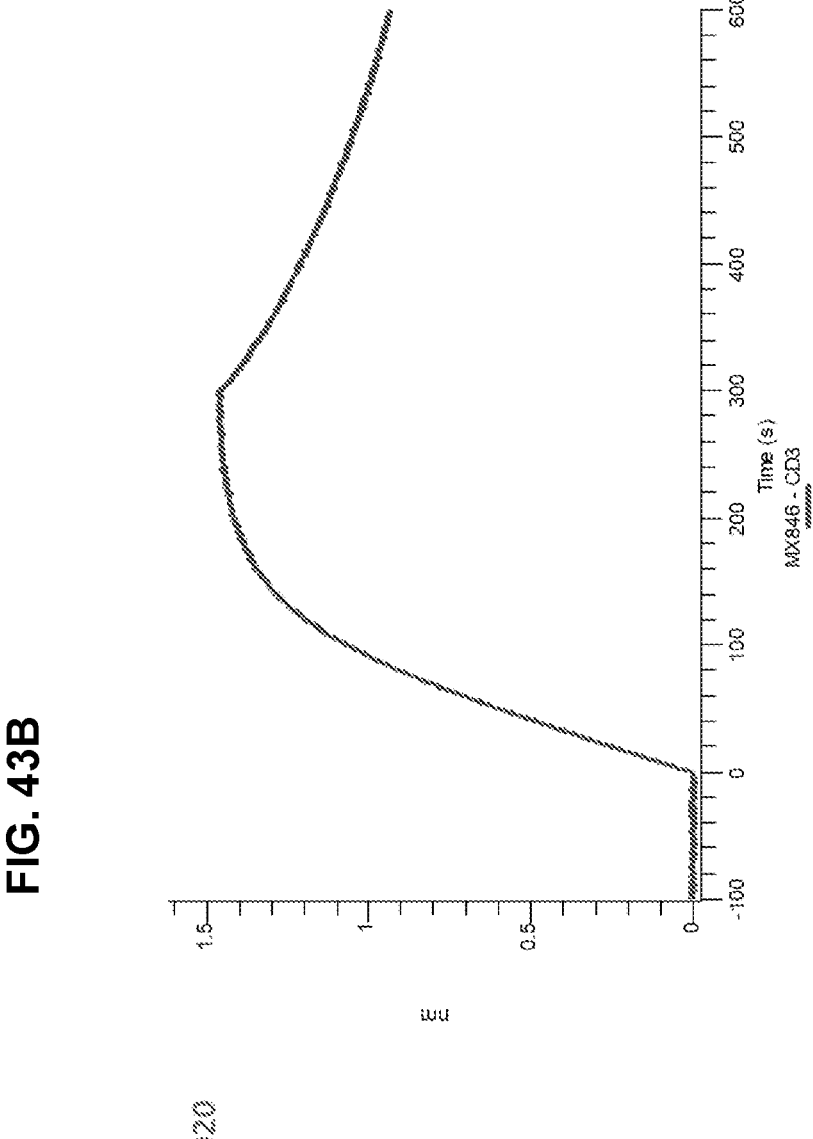
Figure 43C:
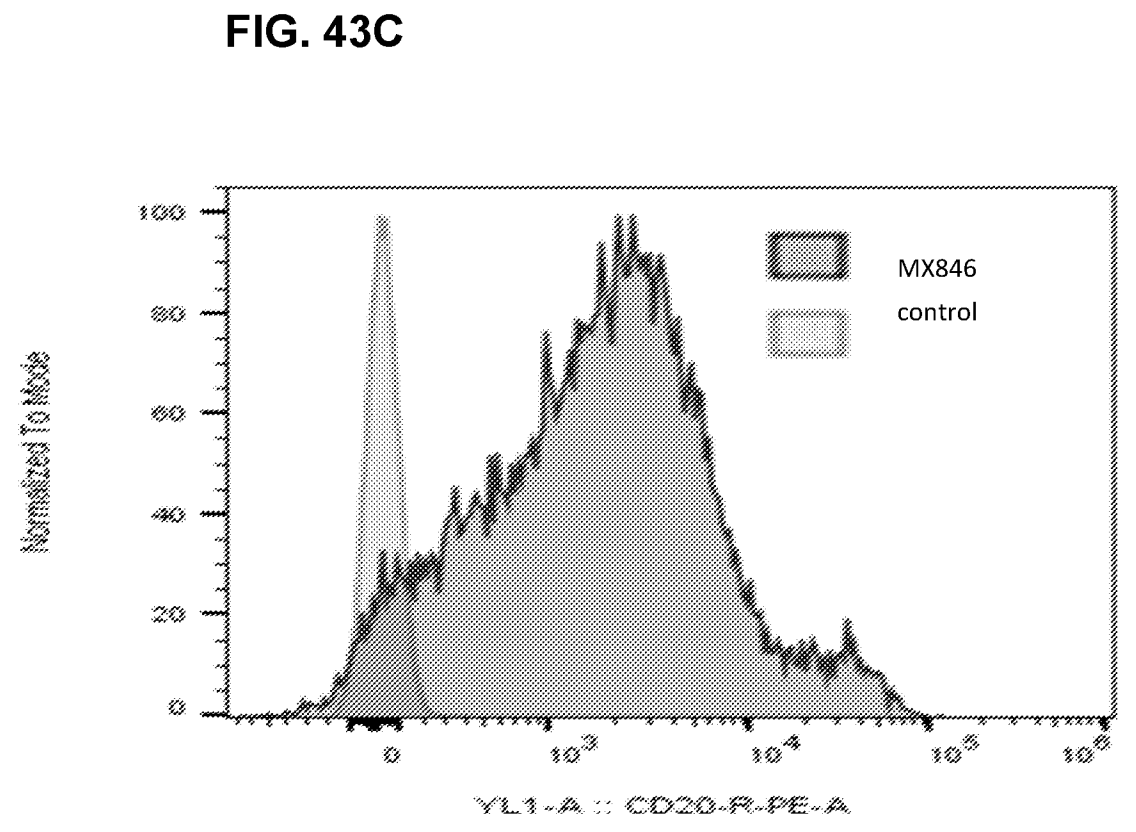

FIG. 43A shows a further non-limiting example of a tetravalent, bispecific antibody configuration, called MX846. MX846 was analyzed for binding to CD3 by biolayer interferometry (BLI) (FIG. 43B), and to CD20 by flow cytometry (FIG. 43C).

Figure 44B:
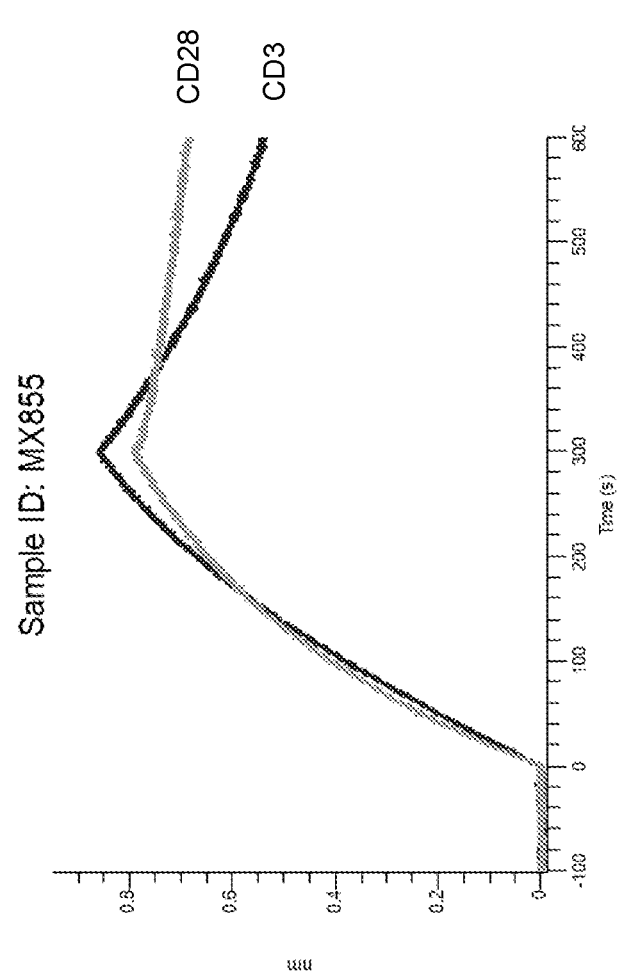
Figure 44A:
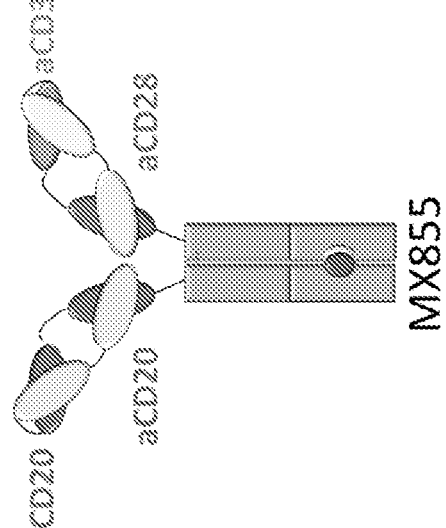
Figure 44C:
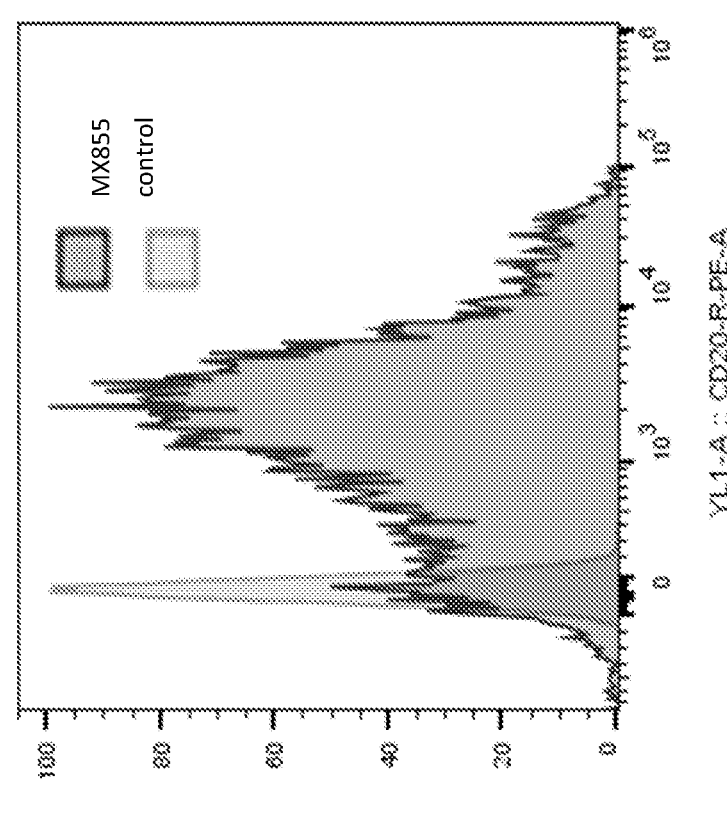

FIG. 44A shows a further non-limiting example of a tetravalent, trispecific antibody configuration, called MX855. MX855 was analyzed for binding to CD3 and CD28 by biolayer interferometry (BLI) (FIG. 44B), and to CD20 by flow cytometry (FIG. 44C).

Figures 45A, 45B:
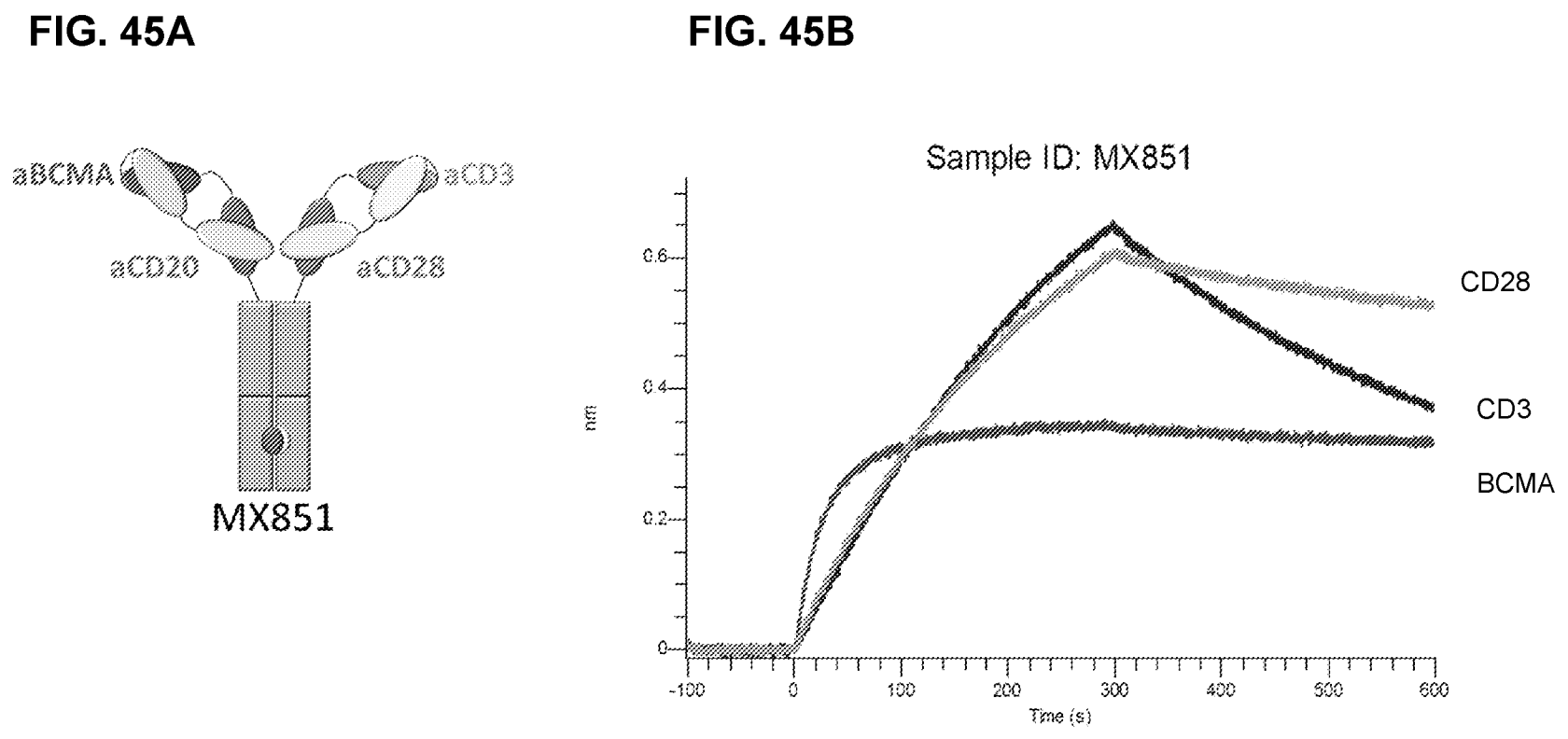
Figure 45C:
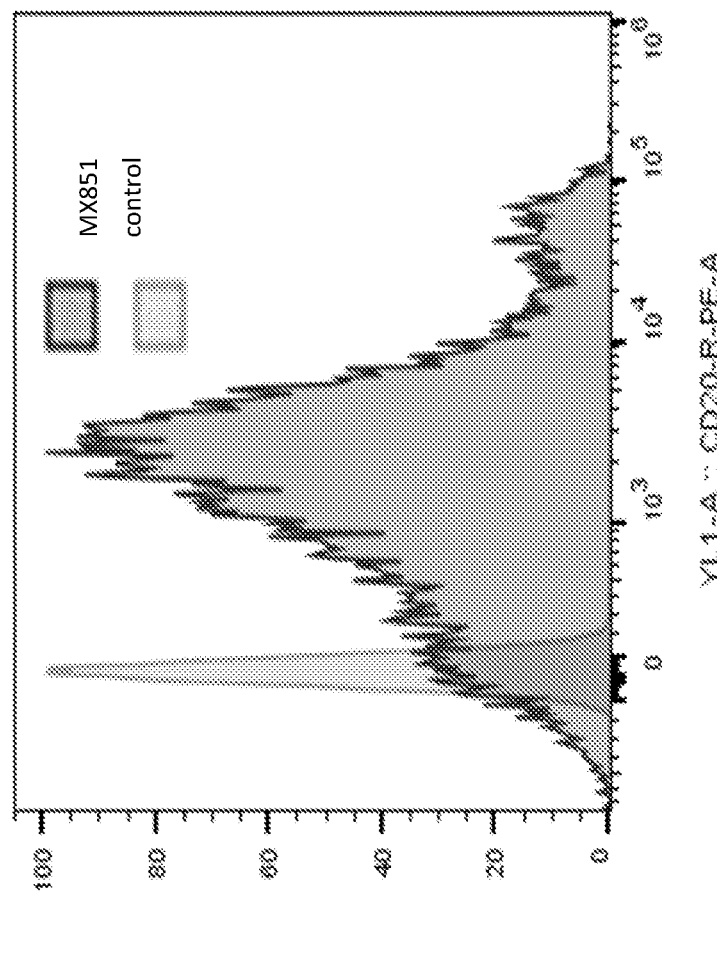

FIG. 45A shows a further non-limiting example of a tetraspecific antibody configuration, called MX851. MX851 was analyzed for binding to CD3, CD28 and BCMA by biolayer interferometry (BLI) (FIG. 45B), and to CD20 by flow cytometry (FIG. 45C).

Figures 46A, 46B:
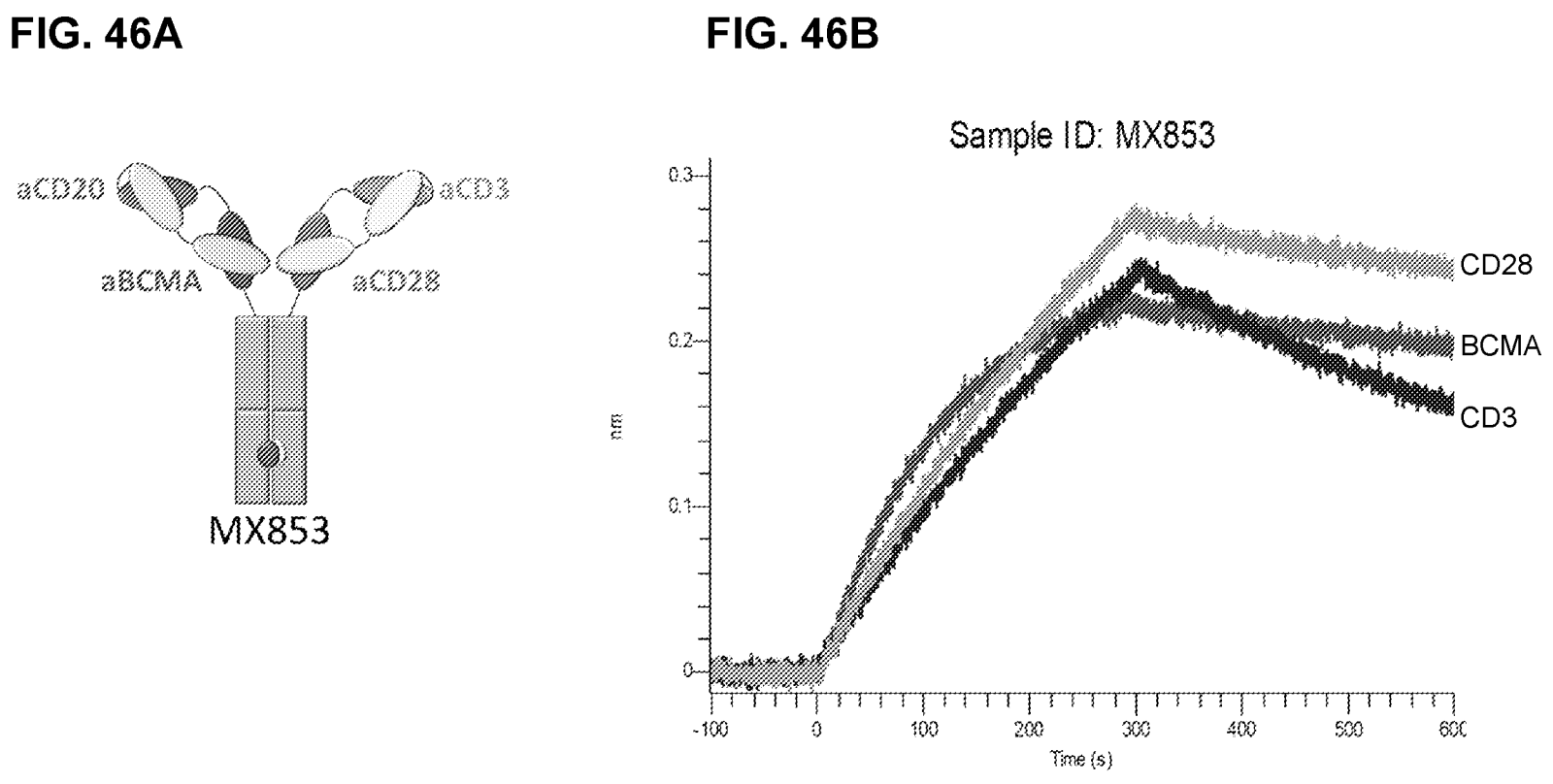
Figure 46C:
Figure 46C:
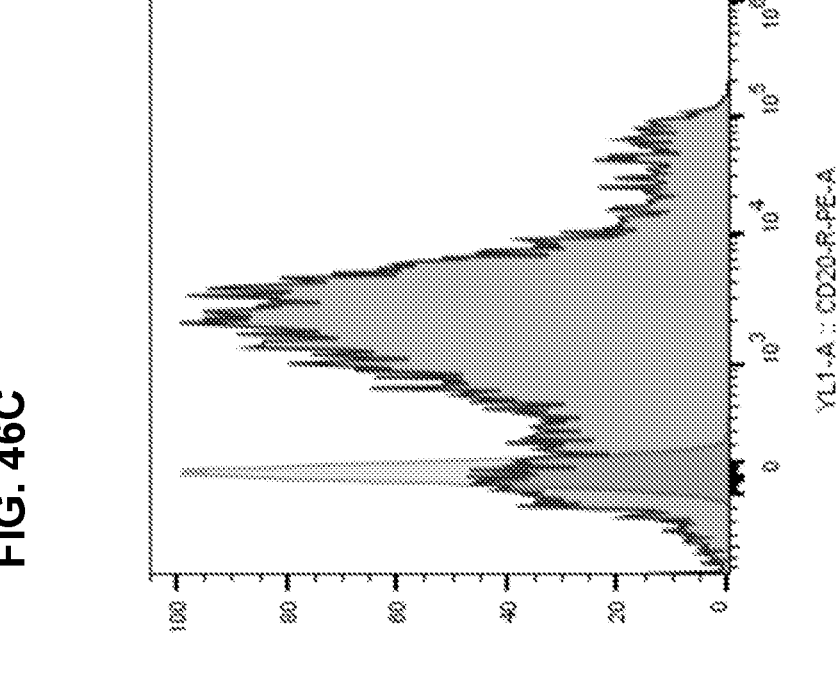

FIG. 46A shows a further non-limiting example of a tetraspecific antibody configuration, called MX853. MX853 was analyzed for binding to CD3, CD28 and BCMA by biolayer interferometry (BLI) (FIG. 46B), and to CD20 by flow cytometry (FIG. 46C).

Figures 47A, 47B:
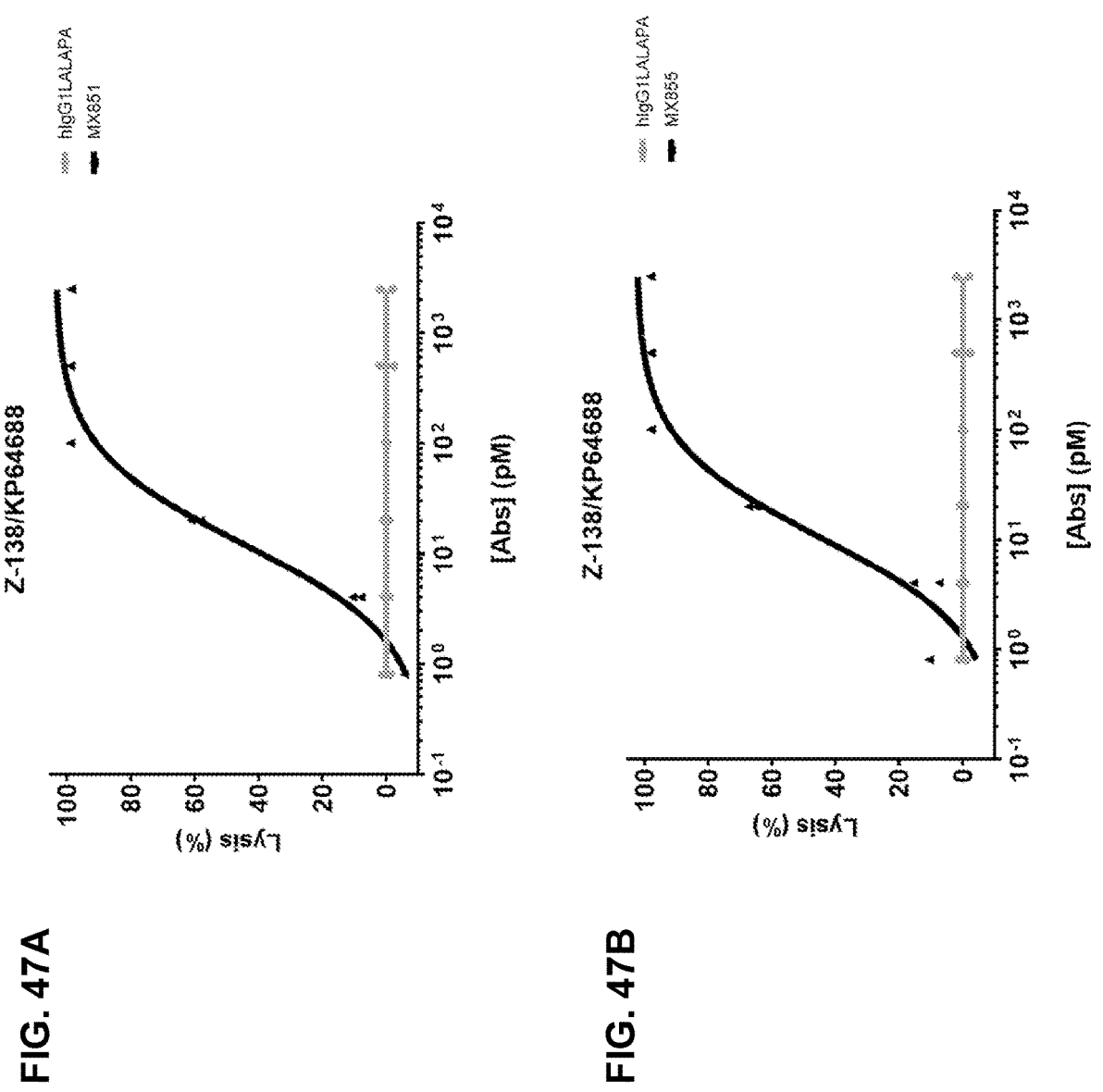

FIGS. 47A-47B show killing of Mantle Cell lymphoma cell line Z-138 by T-cells mediated by tetravalent, tetraspecific MX851 (FIG. 47A) and tetravalent, trispecific MX855 (FIG. 47B).

Figures 48A, 48B:
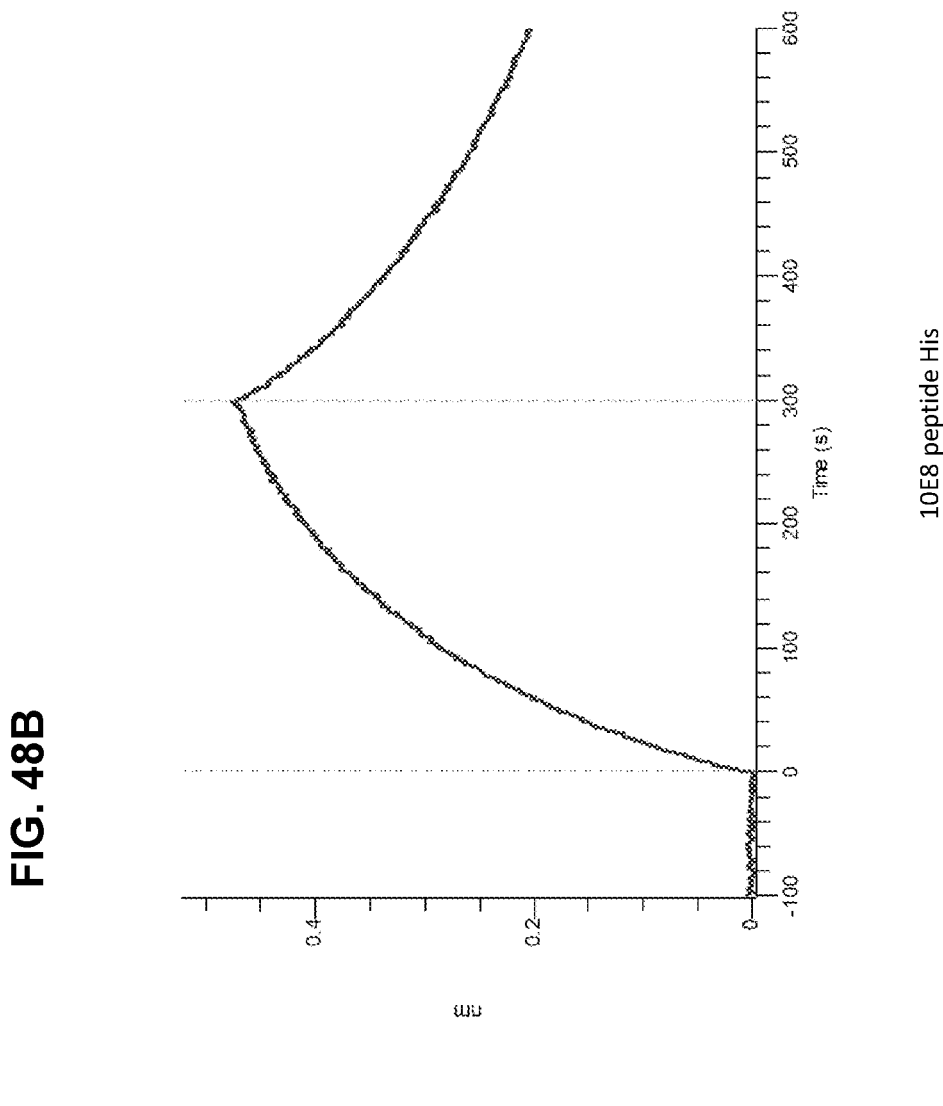

FIG. 48A shows a further non-limiting example of a trispecific antibody configuration, called MX894 (VRC01scFv/PGT121x10e8v4L1IgG1LS). MX894 was analyzed for binding to 10e8 fusion peptide (FIG. 48B), and CD4 site-dependent (FIG. 48C) and CD4 site-independent (FIG. 48D) HIV spike protein by biolayer interferometry (BLI).

Figures 49A, 49B:
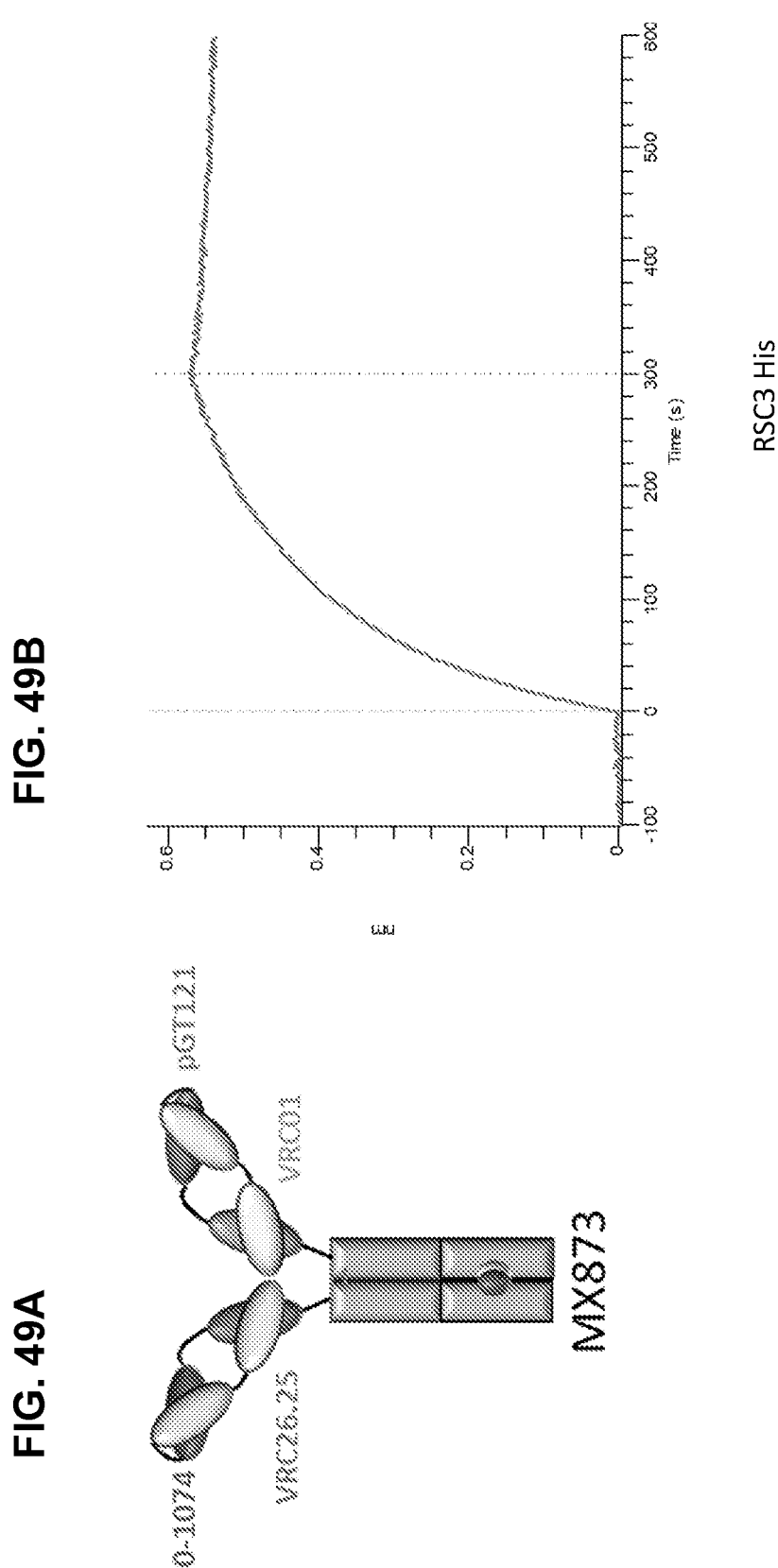

FIG. 49A shows a further non-limiting example of a tetraspecific antibody configuration, called MX873 (VRC26.25×10-1074L9/VRC01×PGT121L1 IgG1LS). MX873 was analyzed for binding to CD4 site-dependent (FIG. 49B) and CD4 site-independent (FIG. 49C) HIV spike protein by biolayer interferometry (BLI).

Figures 50A, 50B:
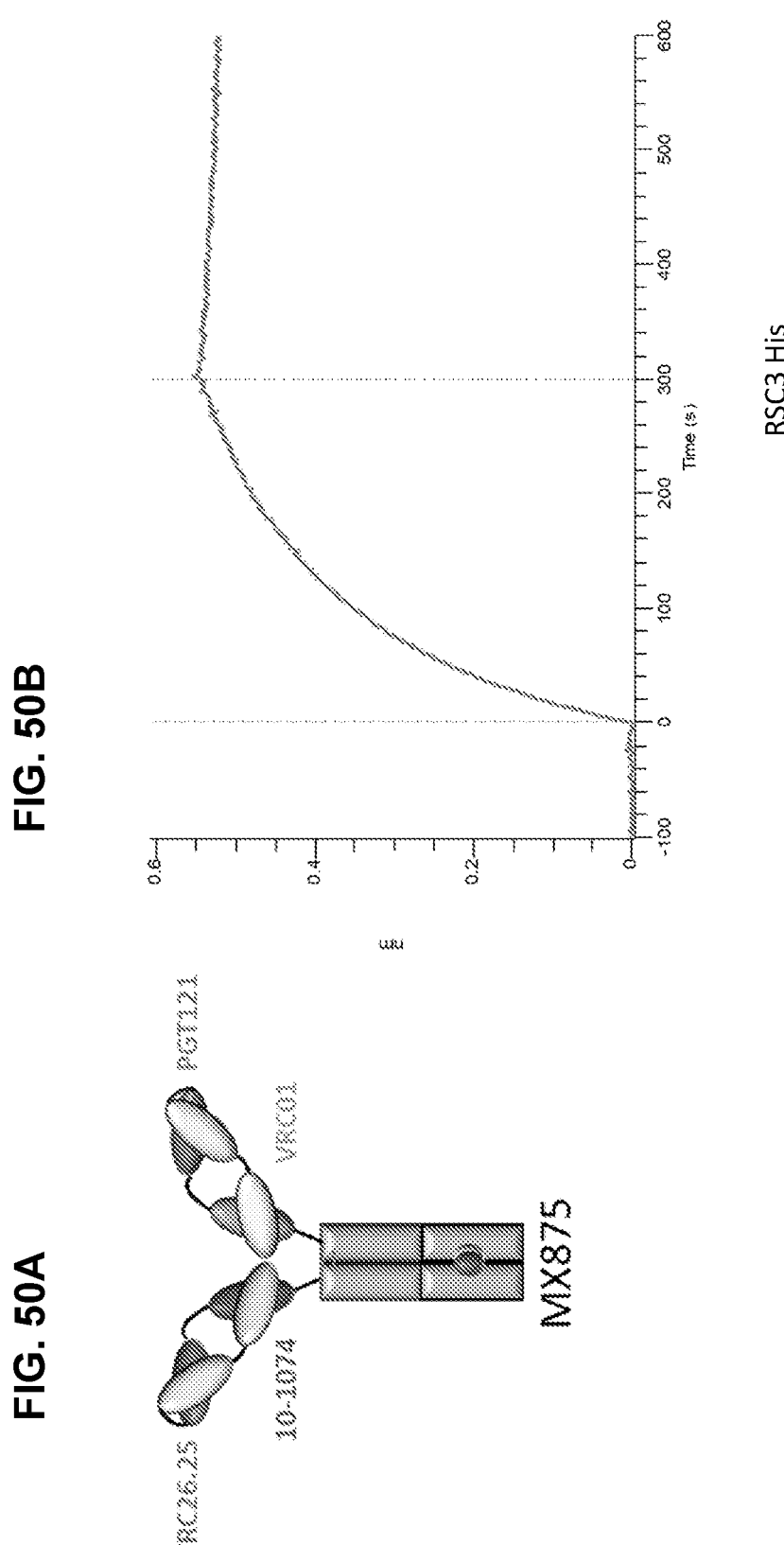

FIG. 50A shows a further non-limiting example of a tetraspecific antibody configuration, called MX875 (10-1074×VRC26.25L9/VRC01×PGT121L1 IgG1LS). MX875 was analyzed for binding to CD4 site-dependent (FIG. 50B) and CD4 site-independent (FIG. 50C) HIV spike protein by biolayer interferometry (BLI).

Figures 51A, 51B:
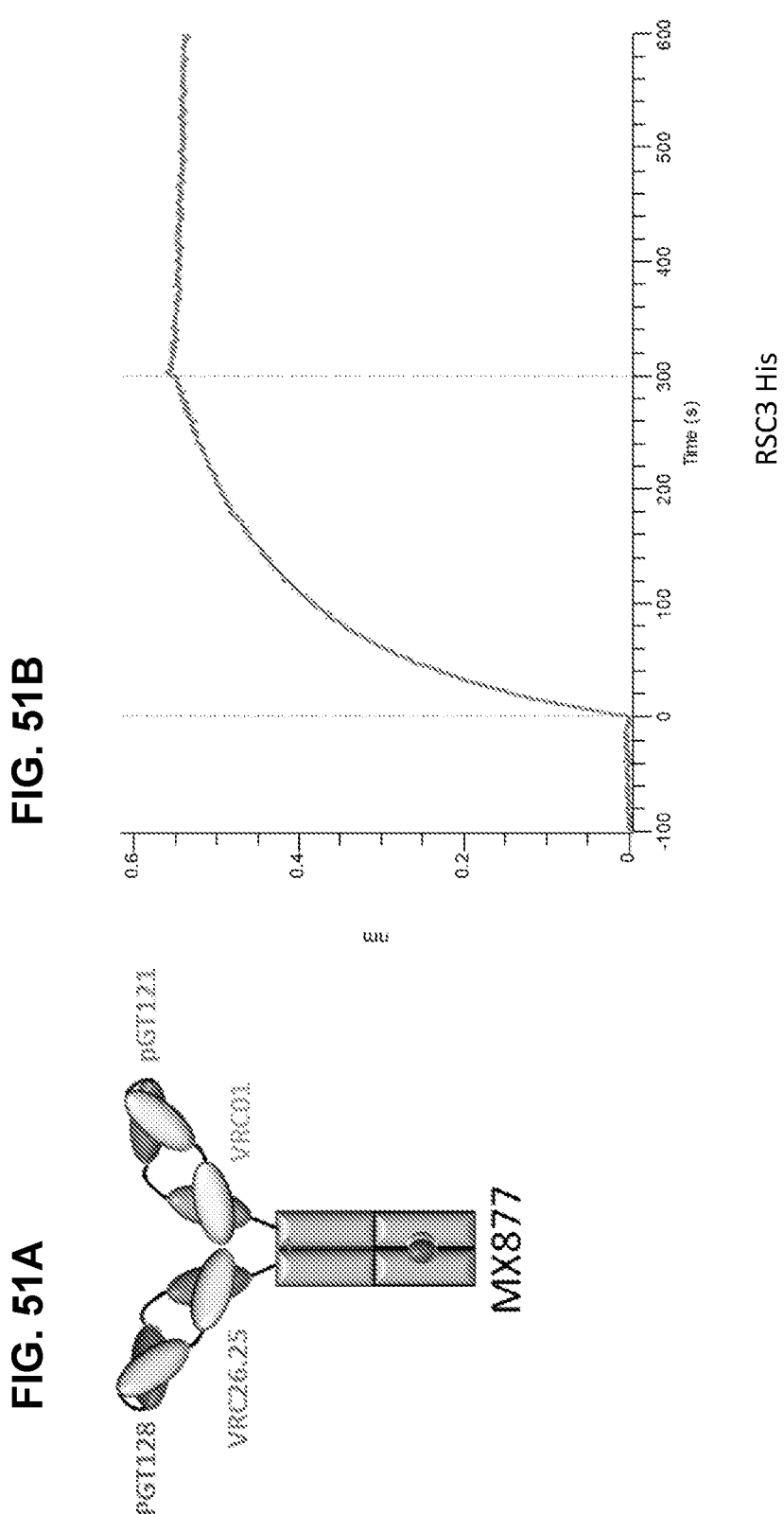

FIG. 51A shows a further non-limiting example of a tetraspecific antibody configuration, called MX877 (STAR_VRC26.25×PGT128L9/STAR_VRC01× PGT121L1 IgG1LS). MX877 was analyzed for binding to CD4 site-dependent (FIG. 51B) and CD4 site-independent (FIG. 51C) HIV spike protein by biolayer interferometry (BLI).

DETAILED DESCRIPTION OF THE INVENTION

The invention is directed to antigen binding polypeptides and antigen binding polypeptide complexes (e.g., antibodies or antigen binding fragments thereof) having improved features. In some aspects, the invention enables the generation of multispecific and multifunctional antigen binding polypeptides and antigen binding polypeptide complexes through the expression of complementary self-assembling heavy and light chains expressed with a single polypeptide per arm and, optionally, with the addition of specific amino acid linkers. Because of this multifunctionality, antigen binding polypeptides and antigen binding polypeptide complexes of the invention can bind to specific combinations of target molecules for selectivity or breadth/neutralization, bring together two or more cell types, bring together targets and deliver activation signals, modify the disease microenvironment, and enhance avidity of binding for improved potency.

Various terms relating to aspects of disclosure are used throughout the specification and claims Such terms are to be given their ordinary meaning in the art, unless otherwise indicated. Other specifically defined terms are to be construed in a manner consistent with the definition provided herein.

Definitions

As used herein, the term "antigen binding polypeptide" refers to a polypeptide having the ability to specifically bind to one or more substances that induce an immune response (i.e., one or more antigens or epitopes).

As used herein, the term "antigen binding polypeptide complex" refers to a group of two, three, four, or more associated polypeptides, wherein at least one polypeptide has the ability to specifically bind to one or more antigens. An antigen binding polypeptide complex, includes, but is not limited to, an antibody or antigen binding fragment thereof.

The term "antibody" includes, without limitation, a glycoprotein immunoglobulin which binds specifically to an antigen and comprises at least two heavy (H) chains and two light (L) chains interconnected by disulfide bonds. Each H chain comprises a heavy chain variable region (abbreviated herein as VH) and a heavy chain constant region. The heavy chain constant region comprises three constant domains, CH1, CH2 and CH3. Each light chain comprises a light chain variable region (abbreviated herein as VL) and a light chain constant region. The light chain constant region comprises one constant domain, CL. The VH and VL regions can be further subdivided into regions of hypervariability, termed complementarity determining regions (CDRs), interspersed with regions that are more conserved, termed framework regions (FR). Each VH and VL comprises three CDRs and four FRs, arranged from amino-terminus to carboxy-terminus in the following order: FR1, CDR1, FR2, CDR2, FR3, CDR3, FR4. The variable regions of the heavy and light chains contain a binding domain that interacts with an antigen. The constant regions of the antibodies may mediate the binding of the immunoglobulin to host tissues or factors, including various cells of the immune system (e.g., effector cells) and the first component (C1q) of the classical complement system. A heavy chain may have the C-terminal lysine or not. Unless specified otherwise herein, the amino acids in the variable regions are numbered using the Kabat numbering system and those in the constant regions are numbered using the EU system.

The term "monoclonal antibody," as used herein, refers to an antibody that is produced by a single clone of B-cells and binds to the same epitope. In contrast, the term "polyclonal antibody" refers to a population of antibodies that are produced by different B-cells and bind to different epitopes of the same antigen. The term "antibody" includes, by way of example, monoclonal and polyclonal antibodies; chimeric and humanized antibodies; human or non-human antibodies; wholly synthetic antibodies; and single chain antibodies. A non-human antibody can be humanized by recombinant methods to reduce its immunogenicity in man.

The antibody can be an antibody that has been altered (e.g., by mutation, deletion, substitution, conjugation to a non-antibody moiety). For example, an antibody can include one or more variant amino acids (compared to a naturally occurring antibody) which change a property (e.g., a functional property) of the antibody. For example, several such alterations are known in the art which affect, e.g., half-life, effector function, and/or immune responses to the antibody in a patient. The term antibody also includes artificial polypeptide constructs which comprise at least one antibody-derived antigen binding site.

An "antigen binding fragment" of an antibody refers to one or more fragments or portions of an antibody that retain the ability to bind specifically to the antigen bound by the whole antibody. It has been shown that the antigen-binding function of an antibody can be performed by fragments or portions of a full-length antibody. An antigen binding fragment can contain the antigenic determining regions of an intact antibody (e.g., the complementarity determining regions (CDRs)). Examples of antigen binding fragments of antibodies include, but are not limited to, Fab, Fab', F(ab')$_2$, and Fv fragments, linear antibodies, and single chain antibodies. An antigen binding fragment of an antibody can be derived from any animal species, such as rodents (e.g., mouse, rat, or hamster) and humans or can be artificially produced.

Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain Fv (scFv); see, e.g., Bird et al. (1988) Science 242:423-426; and Huston et al. (1988) Proc. Natl. Acad. Sci. USA 85:5879-5883). Such single chain antibodies are also intended to be encompassed within the term "antigen-binding fragment" of an antibody.

Antigen binding fragments are obtained using conventional techniques known to those with skill in the art, and the fragments are screened for utility in the same manner as are intact antibodies. Antigen binding fragments can be produced by recombinant DNA techniques, or by enzymatic or chemical cleavage of intact immunoglobulins.

As used herein, the term "variable region" typically refers to a portion of an antibody, generally, a portion of a light or heavy chain, typically about the amino-terminal 110 to 120 amino acids, or 110 to 125 amino acids in the mature heavy chain and about 90 to 115 amino acids in the mature light chain, which differ extensively in sequence among antibodies and are used in the binding and specificity of a particular antibody for its particular antigen. The variability in sequence is concentrated in those regions called complementarity determining regions (CDRs) while the more highly conserved regions in the variable domain are called framework regions (FR). Without wishing to be bound by any particular mechanism or theory, it is believed that the CDRs of the light and heavy chains are primarily responsible for the interaction and specificity of an antibody with antigen. In some aspects, the variable region is a mammalian variable region, e.g., a human, mouse or rabbit variable region. In some aspects, the variable region comprises rodent or murine CDRs and human framework regions (FRs). In some aspects, the variable region is a primate (e.g., non-human primate) variable region. In some aspects, the variable region comprises rodent or murine CDRs and primate (e.g., non-human primate) framework regions (FRs).

The terms "complementarity determining region" or "CDR", as used herein, refer to each of the regions of an antibody variable domain which are hypervariable in sequence and/or form structurally defined loops (hypervariable loops) and/or contain the antigen-contacting residues. Antibodies can comprise six CDRs, e.g., three in the VH and three in the VL.

The terms "VL", "VL region," and "VL domain" are used herein interchangeably to refer to the light chain variable region of an antigen binding polypeptide, antigen binding polypeptide complex, antibody or antigen binding fragment thereof. In some aspects, a VL region is referred to herein as VL1 to denote a first light chain variable region, VL2 to denote a second light chain variable region, VL3 to denote a third light chain variable region, and so on. An enumerated VL region (e.g., VL1) can have the same or different antigen binding properties and/or the same or different sequence as another enumerated VL region (e.g., VL2).

The terms "VH", "VH region," and "VH domain" are used herein interchangeably to refer to the heavy chain variable region of an antigen binding polypeptide, antigen binding polypeptide complex, antibody or antigen binding fragment thereof. In some aspects, a VH region is referred to herein as VH1 to denote a first heavy chain variable region, VH2 to denote a second heavy chain variable region, VH3 to denote a third heavy chain variable region, and so on. An enumerated VH region (e.g., VH1) can have the same or different antigen binding properties and/or the same or different sequence as another enumerated VH region (e.g., VH2).

As used herein, "Kabat numbering" and like terms are recognized in the art and refer to a system of numbering amino acid residues in the heavy and light chain variable regions of an antibody or antigen binding fragment thereof. In some aspects, CDRs can be determined according to the Kabat numbering system (see, e.g., Kabat E A & Wu T T (1971) Ann. NY Acad. Sci. 190: 382-391 and Kabat E A et al., (1991) Sequences of Proteins of Immunological Interest, Fifth Edition, U.S. Department of Health and Human Services, NIH Publication No. 91-3242). Using the Kabat numbering system, CDRs within an antibody heavy chain molecule are typically present at amino acid positions 31 to 35, which optionally can include one or two additional amino acids, following 35 (referred to in the Kabat numbering scheme as 35A and 35B) (CDR1), amino acid positions 50 to 65 (CDR2), and amino acid positions 95 to 102 (CDR3). Using the Kabat numbering system, CDRs within an antibody light chain molecule are typically present at amino acid positions 24 to 34 (CDR1), amino acid positions 50 to 56 (CDR2), and amino acid positions 89 to 97 (CDR3).

As used herein, the terms "constant region" or "constant domain" are used interchangeably to refer to a portion of an antigen binding polypeptide, antigen binding polypeptide complex, antibody or antigen binding fragment thereof, e.g., a carboxyl terminal portion of a light and/or heavy chain which is not directly involved in binding of an antibody to antigen but which can exhibit various effector functions, such as interaction with the Fc region. The constant region generally has a more conserved amino acid sequence relative to a variable region. In some aspects, an antigen binding polypeptide, antigen binding polypeptide complex, antibody or antigen binding fragment thereof comprises a constant region or portion thereof that is sufficient for antibody-dependent cell-mediated cytotoxicity (ADCC), antibody-dependent cellular phagocytosis (ADCP), and complement-dependent cytotoxicity (CDC).

As used herein, the terms "fragment crystallizable region," "Fc region," or "Fc domain" are used interchangeably herein to refer to the tail region of an antibody that interacts with cell surface receptors called Fc receptors and some proteins of the complement system. Fc regions typically comprise CH2 and CH3 regions, and, optionally, an immunoglobulin hinge. Examples of an Fc region include, but are not limited to, an amino acid sequence of any one of SEQ ID NOs:389-402, or an amino acid sequence having at least 80%, at least 85%, at least 90%, at least 95%, at least 96%, at least 97%, at least 98%, or at least 99% identity to any one of SEQ ID NOs:389-402. Examples of a CH2 region include, but are not limited to, an amino acid sequence of any one of SEQ ID NOs:408-413, or an amino acid sequence having at least 80%, at least 85%, at least 90%, at least 95%, at least 96%, at least 97%, at least 98%, or at least 99% identity to any one of SEQ ID NOs:408-413. Examples of a CH3 region include, but are not limited to, an amino acid sequence of any one of SEQ ID NOs:414-417, or an amino acid sequence having at least 80%, at least 85%, at least 90%, at least 95%, at least 96%, at least 97%, at least 98%, or at least 99% identity to any one of SEQ ID NOs:414-417.

As used herein, the terms "immunoglobulin hinge," "hinge," "hinge domain" or "hinge region" are used interchangeably to refer to a stretch of heavy chains between the Fab and Fc portions of an antigen binding polypeptide, antigen binding polypeptide complex, antibody or antigen binding fragment thereof. A hinge provides structure, position and flexibility, which assist with normal functioning of antibodies (e.g., for crosslinking two antigens or binding two antigenic determinants on the same antigen molecule). An immunoglobulin hinge is divided into upper, middle and lower hinge regions that can be separated based on structural and/or genetic components. An immunoglobulin hinge of the invention can contain one, two or all three of these regions. Structurally, the upper hinge region stretches from the C terminal end of CH1 to the first hinge disulfide bond. The middle hinge region stretches from the first cysteine to the last cysteine in the hinge. The lower hinge region extends from the last cysteine to the glycine of CH2. The cysteines present in the hinge form interchain disulfide bonds that link the immunoglobulin monomers.

As used herein, the term "Fab" refers to a region of an antibody that binds to an antigen. It is typically composed of one constant and one variable domain of each of the heavy and the light chain.

As used herein, the term "heavy chain" refers to a portion of an antigen binding polypeptide, antigen binding polypeptide complex, antibody or antigen binding fragment thereof typically composed of a heavy chain variable region (VH), a heavy chain constant region 1 (CH1), a heavy chain constant region 2 (CH2), and a heavy chain constant region 3 (CH3). A typical antibody is composed of two heavy chains and two light chains. When used in reference to an antibody, a heavy chain can refer to any distinct type, e.g., alpha (α), delta (δ), epsilon (ε), gamma (γ), and mu (μ), based on the amino acid sequence of the constant region, which gives rise to IgA, IgD, IgE, IgG, and IgM classes of antibodies, respectively, including subclasses of IgG, e.g., IgG1, IgG2, IgG3, and IgG4. Heavy chain amino acid sequences are known in the art. In some aspects, the heavy chain is a human heavy chain.

As used herein, the term "light chain" refers to a portion of an antigen binding polypeptide, antigen binding polypeptide complex, antibody or antigen binding fragment thereof typically composed of a light chain variable region (VL) and a light chain constant region (CL). A typical antibody is composed of two light chains and two heavy chains. When used in reference to an antibody, a light chain can refer to any distinct type, e.g., kappa (κ) or lambda (λ), based on the amino acid sequence of the constant region. Light chain amino acid sequences are known in the art. In some aspects, the light chain is a human light chain.

The term "chimeric" antibody or antigen binding fragment thereof refers to an antibody or antigen binding fragments thereof wherein the amino acid sequence is derived from two or more species. Typically, the variable region of both light and heavy chains corresponds to the variable region of antibodies or antigen binding fragments thereof derived from one species of mammals (e.g., mouse, rat, rabbit, etc.) with the desired specificity, affinity and capability, while the constant regions are homologous to the sequences in antibodies or antigen binding fragments thereof derived from another (usually human) to avoid eliciting an immune response in that species.

The term "humanized" antibody or antigen binding fragment thereof refers to forms of non-human (e.g., murine) antibodies or antigen binding fragments that are specific immunoglobulin chains, chimeric immunoglobulins, or fragments thereof that contain minimal non-human (e g, murine) sequences. Typically, humanized antibodies or antigen binding fragments thereof are human immunoglobulins in which residues from a complementary determining region (CDR) are replaced by residues from a CDR of a non-human species (e.g., mouse, rat, rabbit, hamster) that have the desired specificity, affinity, and capability (Jones et al., Nature 321:522-525 (1986); Riechmann et al., Nature 332:323-327 (1988); Verhoeyen et al., Science 239:1534-1536 (1988)). In some aspects, the Fv framework region (FR) residues of a human immunoglobulin are replaced with the corresponding residues in an antibody or fragment from a non-human species that has the desired specificity, affinity, and capability. The humanized antibody or antigen binding fragment thereof can be further modified by the substitution of additional residues either in the Fv framework region and/or within the replaced non-human residues to refine and optimize antibody or antigen-binding fragment thereof specificity, affinity, and/or capability. In general, a humanized antibody or antigen binding fragment thereof will comprise substantially all of at least one, and typically two or three, variable domains containing all or substantially all of the CDR regions that correspond to the non-human immunoglobulin whereas all or substantially all of the FR regions are those of a human immunoglobulin consensus sequence. A humanized antibody or antigen binding fragment thereof can also comprise at least a portion of a constant region, typically that of a human immunoglobulin. Examples of methods used to generate humanized antibodies are known and described, for example, in U.S. Pat. No. 5,225,539; Roguska et al., Proc. Natl. Acad. Sci., USA, 91(3):969-973 (1994), and Roguska et al., Protein Eng. 9(10):895-904 (1996).

The term "human" antibody or antigen binding fragment thereof, as used herein, means an antibody or antigen binding fragment thereof having an amino acid sequence derived from a human immunoglobulin gene locus, where such antibody or antigen binding fragment is made using recombinant techniques known in the art. This definition of a human antibody or antigen binding fragment thereof includes intact or full-length antibodies and fragments thereof.

A polypeptide, polypeptide complex, antibody, antigen binding fragment thereof, polynucleotide, vector or host cell which is "isolated" is a polypeptide, polypeptide complex, antibody, antigen binding fragment thereof, polynucleotide, vector or host cell which is in a form not found in nature. Isolated polypeptides, polypeptide complexes, antibodies, antigen binding fragments thereof, polynucleotides, vectors or host cells include those which have been purified to a degree that they are no longer in a form in which they are found in nature. In some aspects, a polypeptide, polypeptide complex, antibody, antigen binding fragment thereof, polynucleotide, vector or host cell which is isolated is substantially pure. As used herein, "substantially pure" refers to material which is at least 50% pure (i.e., free from contaminants), at least 90% pure, at least 95% pure, at least 98% pure, or at least 99% pure.

The terms "polypeptide," "peptide," and "protein" are used interchangeably herein to refer to polymers of amino acids of any length. The polymer can be linear or branched, it can comprise modified amino acids, and it can be interrupted by non-amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids, etc.), as well as other modifications known in the art. It is understood that, because the polypeptides of this invention are based upon antibodies, in some aspects, the polypeptides can occur as single chains or associated chains.

The use of the alternative (e.g., "or") should be understood to mean either one, both, or any combination thereof of the alternatives. As used herein, the indefinite articles "a" or "an" should be understood to refer to "one or more" of any recited or enumerated component.

As used herein, the term "and/or" is to be taken as specific disclosure of each of the two specified features or components with or without the other. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following aspects: A, B, and C; A, B, or C; A or C; A or B; B or C; A and C; A and B; B and C; A (alone); B (alone); and C (alone).

It is understood that wherever aspects are described herein with the language "comprising," "having," or the like, otherwise analogous aspects described in terms of "consisting of" and/or "consisting essentially of" are also provided.

As used herein, the term "about" refers to a value or composition that is within an acceptable error range for the particular value or composition as determined by one of ordinary skill in the art, which will depend in part on how the value or composition is measured or determined, i.e., the limitations of the measurement system. For example, "about" can mean within 1 or more than 1 standard deviation per the practice in the art. Alternatively, "about" can mean a range of up to 10% or 20% (i.e., ±10% or ±20%). For example, about 3 mg can include any number between 2.7 mg and 3.3 mg (for 10%) or between 2.4 mg and 3.6 mg (for 20%). Furthermore, particularly with respect to biological systems or processes, the terms can mean up to an order of magnitude or up to 5-fold of a value. When particular values or compositions are provided in the application and claims, unless otherwise stated, the meaning of "about" should be assumed to be within an acceptable error range for that particular value or composition.

As described herein, any numerical range, concentration range, percentage range, ratio range or integer range is to be understood to include the value of any integer within the recited range and, when appropriate, fractions thereof (such as one-tenth and one-hundredth of an integer), unless otherwise indicated.

Unless defined otherwise, all technical and scientific terms used herein have the same meaning as commonly understood by one of ordinary skill in the art to which this disclosure is related. For example, the Concise Dictionary of Biomedicine and Molecular Biology, Juo, Pei-Show, 2nd ed., 2002, CRC Press; The Dictionary of Cell and Molecular Biology, 5th ed., 2013, Academic Press; and the Oxford Dictionary Of Biochemistry And Molecular Biology, 2006, Oxford University Press, provide one of skill with a general dictionary of many of the terms used in this disclosure.

Units, prefixes, and symbols are denoted in their Systeme International de Unites (SI) accepted form. Numeric ranges are inclusive of the numbers defining the range. The headings provided herein are not limitations of the various aspects of the disclosure, which can be had by reference to the specification as a whole. Accordingly, the terms defined herein are more fully defined by reference to the specification in its entirety.

Various aspects are described in further detail in the following sections.

Antigen Binding Polypeptides and Antigen Binding Polypeptide Complexes

In some aspects, the invention is directed to antigen binding polypeptides and antigen binding polypeptide complexes having certain structural features.

In some aspects, the invention is directed to antigen binding polypeptides and antigen binding polypeptide complexes comprising a polypeptide having a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; or VH1-VL2-VL3-VH3-VH2-VL1. In some aspects, the antigen binding polypeptide or antigen binding polypeptide complex contains an amino acid linker between any two regions denoted in a structure described herein. In some aspects, the antigen binding polypeptide or antigen binding polypeptide complex can contain an Fc region, CH1 region, CL region, CH3 region or any combination thereof. In some aspects, the Fc region, CH1 region, CL region and/or CH3 is located at the carboxy terminus of the antigen binding polypeptide, and is optionally linked to the polypeptide by at least one amino acid linker In some aspects, the Fc region comprises an amino acid sequence of any one of SEQ ID NOs:389-402 or an amino acid sequence having at least 80%, at least 85%, at least 90%, at least 95%, at least 96%, at least 97%, at least 98%, or at least 99% identity to any one of SEQ ID NOs:389-402. In some aspects, the CH1 region comprises an amino acid sequence of any one of SEQ ID NOs:403-407 or an amino acid sequence having at least 80%, at least 85%, at least 90%, at least 95%, at least 96%, at least 97%, at least 98%, or at least 99% identity to any one of SEQ ID NOs:403-407. In some aspects, the CL region comprises an amino acid sequence of SEQ ID NO:418 or 419 or an amino acid sequence having at least 80%, at least 85%, at least 90%, at least 95%, at least 96%, at least 97%, at least 98% or at least 99% identity to SEQ ID NO:418 or 419. In some aspects, the antigen binding polypeptide complex is an antibody or antigen binding fragment thereof.

In some aspects, an antigen binding polypeptide of antigen binding polypeptide complex of the invention comprises a polypeptide having a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; orVH1-L1-VL2-L2-VL3-L3-VH3-L4-VH2-L5-VL1;
wherein VL1 is a first immunoglobulin light chain variable region; VL2 is a second immunoglobulin light chain variable region; VL3 is a third immunoglobulin light chain variable region; VH1 is a first immunoglobulin heavy chain variable region; VH2 is a second immunoglobulin heavy chain variable region; VH3 is a third immunoglobulin heavy chain variable region; and L1, L2, L3, L4 and L5 are amino acid linkers.

In some aspects, the antigen binding polypeptide complex comprises a first polypeptide and a second polypeptide; wherein the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; or VH1-L1-VL2-L2-VL3-L3-VH3-L4-VH2-L5-VL1; wherein the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-

VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1 is a first immunoglobulin light chain variable region; VL2 is a second immunoglobulin light chain variable region; VL3 is a third immunoglobulin light chain variable region; VL4 is a fourth immunoglobulin light chain variable region; VL5 is a fifth immunoglobulin light chain variable region; VL6 is a sixth immunoglobulin light chain variable region; VH1 is a first immunoglobulin heavy chain variable region; VH2 is a second immunoglobulin heavy chain variable region; VH3 is a third immunoglobulin heavy chain variable region; VH4 is a fourth immunoglobulin heavy chain variable region; VH5 is a fifth immunoglobulin heavy chain variable region; VH6 is a sixth immunoglobulin heavy chain variable region; and L1, L2, L3, L4, L5, L6, L7, L8, L9 and L10 are amino acid linkers. In some aspects, the first polypeptide has a structure represented by VL1-VL2-VL3-VH3-VH2-VH1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VH5- L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VH4; VH4-L6-VH5-L7-VL6-L8-VH6-L9-VL5-L10-VH4; VL4-L6-VH5-L7-VH6-L8-VL6-L9-VL5-L10-VH4; or VH4-L6-VL5-L7-VL6- L8-VH6-L9-VH5-L10-VL4. In some aspects, the first polypeptide has a structure represented by VH1-VH2-VH3-VL3-VL2-VL1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VH5-L7-VL6-L8-VH6-L9-VL5-L10-VH4; or VH4-L6-VL5-L7-VL6- L8-VH6-L9-VH5-L10-VL4. In some aspects, the first polypeptide has a structure represented by VL1-VH2-VL3-VH3-VL2-VH1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-

VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6- L9-VH5-L10-VL4. In some aspects, the first polypeptide has a structure represented by VH1-VL2-VH3-VL3-VH2-VL1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VH4; VH4-L6-VH5-L7-VL6-L8-VH6-L9-VL5-L10-VH4; VL4-L6-VH5-L7-VH6-L8-VL6-L9-VL5-L10-VH4; or VH4-L6-VL5-L7-VL6-L8-VH6-L9-VH5- L10-VL4. In some aspects, the first polypeptide has a structure represented by VL1-VL2-VH3-VL3-VH2-VH1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5- L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10- VL4. In some aspects, the first polypeptide has a structure represented by VH1-VH2-VL3-VH3-VL2-VL1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5- L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-L6-VL5-L7-VL6-L8-VH6-L9-VH5-L10-VH4; VH4-L6-VH5-L7-VH6- L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VH4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VL1-VH2-VH3-VL3-VL2-VH1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-

VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VH1-VL2-VL3-VH3-VH2-VL1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VL6-VH6-VL5-VH4; VH4-VL5-VH6-VL6-VH5-VL4; VL4-VL5-VH6-VL6-VH5-VH4; VH4-VL5-VH6-VL6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; or VH4-L6-VL5-L7-VL6-L8-VH6-L9-VH5-L10-VL4. In some aspects, the first polypeptide has a structure represented by VL1-L1-VL2-L2-VL3-L3-VH3-L4-VH2-L5-VH1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-L6-VH5-L7-VH6-L8-VL6-L9-VL5-L10-VL4; VL4-L6-VH5-L7-VH6-L8-VL6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; or VH4-L6-VL5-L7-VL6-L8-VH6-L9-VH5-L10-VL4. In some aspects, the first polypeptide has a structure represented by VH1-L1-VH2-L2-VH3-L3-VL3-L4-VL2-L5-VL1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VH6-VL6-VL5-VL4; VL4-VH5-VL6-VH6-VL5-VH4; VH4-VL5-VH6-VL6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VH6-L9-VH5-L10-VH4; VH4-L6-VH5-L7-VH6-L8-VL6-L9-VH5-L10-VL4; VL4-L6-VH5-L7-VL6-L8-VH6-L9-VH5-L10-VH4; VH4-L6-VL5-L7-VH6-L8-VH6-L9-VH5-L10-VL4; VL4-L6-VL5-L7-VH6-L8-

VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10- VL4. In some aspects, the first polypeptide has a structure represented by VL1-L1-VH2-L2-VL3-L3-VH3-L4-VL2-L5-VH1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5- L10-VL4. In some aspects, the first polypeptide has a structure represented by VH1-L1-VL2-L2-VH3-L3-VL3-L4-VH2-L5-VL1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6- L9-VH5-L10-VL4. In some aspects, the first polypeptide has a structure represented by VL1-L1-VL2-L2-VH3-L3-VL3-L4-VH2-L5-VH1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5- L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VH4; VH4-L6-VH5-L7-VH6-L8-VL6-L9-VL5-L10-VH4; or VH4-L6-VL5-L7-VL6- L8-VH6-L9-VH5-L10-VL4. In some aspects, the first polypeptide has a structure represented by VH1-L1-VH2-L2-VL3-L3-VH3-L4-VL2-L5-VL1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-

VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VL4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VL1-L1-VH2-L2-VH3-L3-VL3-L4-VL2-L5-VH1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VH5-VL4; VH4-VH5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4.

In some aspects, the antigen binding polypeptide further comprises at least one Fc region which is optionally positioned at its carboxy terminus; or the antigen binding polypeptide complex comprises a polypeptide further comprising at least one Fc region which is optionally positioned at its carboxy terminus. The Fc region can be linked to the polypeptide via at least one amino acid linker. For example, the antigen binding polypeptide or polypeptide comprised within the antigen binding complex may have a structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; VH1-VL2-VH3-VH2-VL1-Fc; VL1-L1-VL2-L2-VL3-L3-VH3-L4-VH2-L5-VH1-Fc; VL1-L1-VL2-L2-VL3-L3-VH3-L4-VH2-L5-VH1-L6-Fc; VH1-L1-VH2-L2-VH3-L3-VL3-L4-VL2-L5-VL1-Fc; VH1-L1-VH2-L2-VH3-L3-VL3-L4-

VL2-L5-VL1-L6-Fc; VL1-L1-VH2-L2-VL3-L3-VH3-L4-VL2-L5-VH1-Fc; VL1-L1-VH2-L2-VL3-L3-VH3-L4-VL2- L5-VH1-L6-Fc; VH1-L1-VL2-L2-VH3-L3-VL3-L4-VH2-L5-VL1-Fc; VH1-L1-VL2-L2-VH3-L3-VL3-L4-VH2-L5- VL1-L6-Fc; VL1-L1-VL2-L2-VH3-L3-VL3-L4-VH2-L5-VH1-Fc; VL1-L1-VL2-L2-VH3-L3-VL3-L4-VH2-L5-VH1- L6-Fc; VH1-L1-VH2-L2-VL3-L3-VH3-L4-VL2-L5-VL1-Fc; VH1-L1-VH2-L2-VL3-L3-VH3-L4-VL2-L5-VL1-L6-Fc; VL1-L1-VH2-L2-VL3-L3-VH3-L4-VL2-L5-VH1-Fc; VL1-L1-VH2-L2-VL3-L3-VH3-L4-VL2-L5-VH1-L6-Fc; VH1- L1-VL2-L2-VL3-L3-VH3-L4-VH2-L5-VL1-Fc; or VH1-L1-VL2-L2-VL3-L3-VH3-L4-VH2-L5-VL1-L6-Fc; wherein VL1 is a first immunoglobulin light chain variable region; VL2 is a second immunoglobulin light chain variable region; VL3 is a third immunoglobulin light chain variable region; VH1 is a first immunoglobulin heavy chain variable region; VH2 is a second immunoglobulin heavy chain variable region; VH3 is a third immunoglobulin heavy chain variable region; Fc is a region comprising an immunoglobulin heavy chain constant region 2 (CH2), an immunoglobulin heavy chain constant region 3 (CH3), and optionally, an immunoglobulin hinge; and L1, L2, L3, L4, L5 and L6 are amino acid linkers.

In some aspects, the antigen binding polypeptide comprises at least two Fc regions at the carboxy terminus or the antigen binding polypeptide complex comprises a polypeptide comprising at least two Fc regions at its carboxy terminus. The at least two Fc regions can be linked to the polypeptide via at least one amino acid linker. The at least two Fc regions can be linked to each other via at least one amino acid linker. For example, the antigen binding polypeptide or polypeptide comprised within the antigen binding polypeptide complex may have a structure represented by VL1-VL2-VL3-VH3-VH2-VH1-Fc-Fc; VH1-VH2-VH3-VL3-VL2-VL1-Fc-Fc; VL1-VH2-VL3-VH3-VL2-VH1-Fc-Fc; VH1-VL2-VH3-VL3-VH2-VL1-Fc-Fc; VL1-VL2-VH3-VL3-VH2-VH1-Fc-Fc; VH1-VH2-VL3-VH3-VL2-VL1-Fc-Fc; VL1-VH2-VH3-VL3-VL2-VH1-Fc-Fc; VH1-VL2-VL3-VH3-VH2-VL1-Fc-Fc; VL1-L1-VL2-L2-VL3-L3-VH3-L4-VH2-L5-VH1-Fc-Fc; VL1-L1-VL2-L2-VL3-L3-VH3-L4-VH2-L5-VH1-L6-Fc-Fc; VL1-L1-VL2-L2-VL3-L3-VH3-L4-VH2-L5-VH1-L6-Fc-L7-Fc; VH1-L1-VH2-L2-VH3-L3-VL3-L4-VL2-L5-VL1-Fc-Fc; VH1-L1-VH2-L2-VH3-L3-VL3-L4-VL2-L5-VL1-L6-Fc-Fc; VH1-L1-VH2-L2-VH3-L3-VL3-L4-VL2-L5-VL1-L6-Fc-L7-Fc; VL1-L1-VH2-L2-VL3-L3-VH3-L4-VL2-L5-VH1-Fc-Fc; VL1-L1-VH2-L2-VL3-L3-VH3-L4-VL2-L5-VH1-L6-Fc-Fc; VL1-L1-VH2-L2-VL3-L3-VH3-L4-VL2-L5-VH1-L6-Fc-L7-Fc; VH1-L1-VL2-L2-VH3-L3-VL3-L4-VH2-L5-VL1-Fc-Fc; VH1-L1-VL2-L2-VH3-L3-VL3-L4-VH2-L5-VL1-L6-Fc-Fc; VH1-L1-VL2-L2-VH3-L3-VL3-L4-VH2-L5-VL1-L6-Fc-L7-Fc; VL1-L1-VL2-L2-VH3-L3-VL3-L4-VH2-L5-VH1-Fc-Fc; VL1-L1-VL2-L2-VH3-L3-VL3-L4-VH2-L5-VH1-L6-Fc-Fc; VL1-L1-VL2-L2-VH3-L3-VL3-L4-VH2-L5-VH1-L6-Fc-L7-Fc; VH1-L1-VH2-L2-VL3-L3-VH3-L4-VL2-L5-VL1-Fc-Fc; VH1-L1-VH2-L2-VL3-L3-VH3-L4-VL2-L5-VL1-L6-Fc-Fc; VH1-L1-VH2-L2-VL3-L3-VH3-L4-VL2-L5-VL1-L6-Fc- L7-Fc; L1-L1-VH2-L2-VL3-L3-VL3-L4-VL2-L5-VH1-Fc-Fc; VL1-L1-VH2-L2-VL3-L3-VL3-L4-VL2-L5-VH1-L6-Fc-Fc; VL1-L1-VH2-L2-VL3-L3-VL3-L4-VL2-L5-VH1-L6-Fc-L7-Fc; VH1-L1-VL2-L2-VL3-L3-VH3-L4-VH2-L5-VL1-Fc-Fc; VH1-L1-VL2-L2-VL3-L3-VH3-L4-VH2-L5-VL1-L6-Fc-Fc; or VH1-L1-VL2-L2-VL3-L3-VH3-L4-VH2-L5-VL1-L6-Fc-L7-Fc; wherein VL1 is a first immunoglobulin light chain variable region; VL2 is a second immunoglobulin light chain variable region; VL3 is a third immunoglobulin light chain variable region; VH1 is a first immunoglobulin heavy chain variable region; VH2 is a second immunoglobulin heavy chain variable region; VH3 is a third immunoglobulin heavy chain variable region; Fc is a region comprising an immunoglobulin heavy chain constant region 2 (CH2), an immunoglobulin heavy chain constant region 3 (CH3), and optionally, an immunoglobulin hinge; and L1, L2, L3, L4, L5, L6 and L7 are amino acid linkers.

In some aspects, the antigen binding polypeptide complex comprises a first polypeptide and a second polypeptide each comprising at least one Fc; which is optionally positioned at the carboxy terminus. For example, the antigen binding complex may comprise a first polypeptide and a second polypeptide wherein the first polypeptide has a structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; VH1-VL2-VL3-VH3-VH2-VL1-Fc; VL1-L1-VL2-L2-VL3-L3-VH3-L4-VH2-L5-VH1-Fc; VL1-L1-VL2-L2-VL3-L3-VH3-L4-VH2-L5-VH1-L6-Fc; VH1-L1-VH2-L2-VH3-L3-VL3-L4-VL2-L5-VL1-Fc; VH1-L1-VH2-L2-VH3-L3-VL3-L4-VL2-L5-VL1-L6-Fc; VL1-L1-VH2-L2-VL3-L3-VH3-L4-VL2- L5-VH1-Fc; VL1-L1-VH2-L2-VL3-L3-VH3-L4-VL2-L5-VH1-L6-Fc; VH1-L1-VL2-L2-VH3-L3-VL3-L4-VH2-L5- VL1-Fc; VH1-L1-VL2-L2-VH3-L3-VL3-L4-VH2-L5-VL1-L6-Fc; VL1-L1-VL2-L2-VH3-L3-VL3-L4-VH2-L5-VH1- Fc; VL1-L1-VL2-L2-VH3-L3-VL3-L4-VH2-L5-VH1-L6-Fc; VH1-L1-VH2-L2-VL3-L3-VH3-L4-VL2-L5-VL1-Fc; VH1-L1-VH2-L2-VL3-L3-VH3-L4-VL2-L5-VL1-L6-Fc; VL1-L1-VH2-L2-VH3-L3-VL3-L4-VL2-L5-VH1-Fc; VL1- L1-VH2-L2-VH3-L3-VL3-L4-VL2-L5-VH1-L6-Fc; VH1-L1-VL2-L2-VL3-L3-VH3-L4-VH2-L5-VL1-Fc; or VH1-L1-VL2-L2-VL3-L3-VH3-L4-VH2-L5-VL1-L6-Fc; wherein the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VH5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VH5-L11-VH4-L12-Fc; or VH4-L7-VL5-L8-VL6-L9-VH6-L10-VH5-L11-VL4-L12-Fc; wherein VL1 is a first immunoglobulin light chain variable region; VL2 is a second immunoglobulin light chain variable region; VL3 is a third immunoglobulin light chain variable region; VL4 is a fourth immunoglobulin light chain variable region; VL5 is a fifth immunoglobulin light chain variable region; VL6 is a sixth immunoglobulin light chain variable region; VH1 is a first immunoglobulin heavy chain variable region; VH2 is a second immunoglobulin heavy chain variable region; VH3 is a third immunoglobulin heavy chain variable region; VH4 is a fourth immunoglobulin heavy chain variable region; VH5 is a fifth immunoglobulin heavy chain variable region; VH6 is a sixth immunoglobulin heavy chain variable region; Fc is a region comprising an immunoglobulin heavy chain constant region 2 (CH2), an immunoglobulin heavy chain constant region 3 (CH3), and optionally, an immunoglobulin hinge; and L1, L2, L3, L4, L5, L6, L7, L8, L9, L10, L11 and L12 are amino acid linkers. In some aspects, the first polypeptide has a structure represented by VL1-VL2-VL3-VH3-VH2-VH1-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VH5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VH5-L11-VH4-L12-Fc; or VH4-L7-VL5-L8-VL6-L9-VH6-L10-VH5-L11-VL4-L12-Fc. In some aspects, the first polypeptide has a structure represented by VH1-VH2-VH3-VL3-VL2-VL1-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VH5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-

Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-VH2-VL3-VH3-VL2-VH1-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-VH2-VL3-VH3-VL2-VL1-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-VH2-VH3-VL3-VL2-VH1-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-

Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-VL2-VL3-VH3-VH2-VL1-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-L1-VL2-L2-VL3-L3-VH3-L4-VH2-L5-VH1-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-

VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-L1-VL2-L2-VL3-L3-VH3-L4-VH2-L5-VH1-L6-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-L1-VH2-L2-VH3-L3-VL3-L4-VL2-L5-VL1-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-

VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12- Fc; or VH4-L7-VL5-L8-VL6-L9-VH6-L10-VH5-L11-VL4-L12-Fc. In some aspects, the first polypeptide has a structure represented by VH1-L1-VH2-L2-VH3-L3-VL3-L4-VL2-L5-VL1-L6-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-L1-VH2-L2-VL3-L3-VH3-L4-VL2-L5-VH1-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12- Fc; VL4-L7-VH5-L8-VL6-L9-VH6-L10-VL5-L11-VH4-L12-Fc; VH4-L7-VL5-L8-VH6-L9-VL6-L10-VH5-L11-VL4- L12-Fc; VL4-L7-VL5-L8-

VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-L1-VH2-L2-VL3-L3-VH3-L4-VL2-L5-VH1-L6-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-L1-VL2-L2-VH3-L3-VL3-L4-VH2-L5-VL1-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12- Fc; VH4-L7-VH5-L8-VH6-L9-VL6-L10-VL5-L11-VL4-L12-Fc; VL4-L7-VH5-L8-VL6-L9-VH6-L10-VL5-L11-VH4- L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-L1-VL2-L2-VH3-L3-VL3-L4-VH2-

L5-VL1-L6-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VL6-L9-VH6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-L1-VL2-L2-VH3-L3-VL3-L4-VH2-L5-VH1-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VL6-L9-VH6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-L1-VL2-L2-VH3-L3-VL3-L4-VH2-L5-VH1-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-

Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VH6-VL6-VH5-VL4-Fc; VL4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-L1-VH2-L2-VL3-L3-VH3-L4-VL2-L5-VL1-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VL6-L9-VH6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12- Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-L1-VH2-L2-VL3-L3-VH3-L4-VL2-L5-VL1-L6-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-

L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VL5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VL4-Fc; VH4-L7-VH5-L8-VL6-L9-VH6-L10-VL5-L11-VL4-Fc; VL4-L7-VH5-L8-VH6-L9-VL6-L10-VH5-L11-VL4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VH5-L11-VH4-L12-Fc; or VH4-L7-VL5-L8-VL6-L9-VH6-L10-VH5-L11-VL4-L12-Fc. In some aspects, the first polypeptide has a structure represented by VL1-L1-VH2-L2-VH3-L3-VL3-L4-VL2-L5-VH1-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VH5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VH5-L11-VH4-L12-Fc; or VH4-L7-VL5-L8-VL6-L9-VH6-L10-VH5-L11-VL4-L12-Fc. In some aspects, the first polypeptide has a structure represented by VL1-L1-VH2-L2-VH3-L3-VL3-L4-VL2-L5-VH1-L6-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc;

L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-L1-VL2-L2-VL3-L3-VH3-L4-VH2-L5-VL1-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VH5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VH6-L10-VL5-L11-VL4-L12-Fc; VH4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-L1-VL2-L2-VL3-L3-VH3-L4-VH2-L5-VL1-L6-Fc; and the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VL5-VH6-VL6-VH5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-

VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc.

In some aspects, the antigen binding polypeptide further comprises at least one CH1 region and/or CL region, which is optionally positioned at its carboxy terminus. For example, the carboxy terminus of the polypeptide may comprise a CH1 region. For example, the carboxy terminus of the polypeptide may comprise a CL region. For example, the carboxy terminus of the polypeptide may comprise both a CH1 and a CL region. In some aspects, the carboxy terminus of the polypeptide comprises the structure CH1-CL. In some aspects, the carboxy terminus of the polypeptide comprises the structure CL-CH1. The CH1 region and/or CL region can be linked to the polypeptide via one or more amino acid linker. When both the CH1 region and CL region are present, they can be linked to each other via one or more amino acid linker. For example, the antigen binding polypeptide may have a structure represented by VL1-VL2-VL3-VH3-VH2-VH1-CH1-CL; VL1-VL2-VL3-VH3-VH2-VH1-CL-CH1; VH1-VH2-VH3-VL3-VL2-VL1-CH1-CL; VH1-VH2-VH3-VL3-VL2-VL1-CL-CH1; VL1-VH2-VL3-VH3-VL2-VH1-CH1-CL; VL1-VH2-VL3-VH3-VL2-VH1-CL-CH1; VH1-VL2-VH3-VL3-VH2-VL1-CH1-CL; VH1-VL2-VH3-VL3-VH2-VL1-CL-CH1; VL1-VL2-VH3-VL3-VH2-VH1-CH1-CL; VL1-VL2-VH3-VL3-VH2-VH1-CL-CH1; VH1-VH2-VL3-VH3-VL2-VL1-CH1-CL; VH1-VH2-VL3-VH3-VL2-VL1-CL-CH1; VL1-VH2-VH3-VL3-VL2-VH1-CH1-CL; VL1-VH2-VH3-VL3-VL2-VH1-CL-CH1; VH1-VL2-VL3-VH3-VH2-VL1-CH1-CL; VH1-VL2-VL3-VH3-VH2-VL1-CL-CH1; VL1-L1-VL2-L2-VL3-L3-VH3-L4-VH2-L5-VH1-CH1-CL; VL1-L1-VL2-L2-VL3-L3-VH3-L4-VH2-L5-VH1-L6-CH1-CL; VL1-L1-VL2-L2-VL3-L3-VH3-L4-VH2-L5-VH1-L6-CH1-L7-CL; VL1-L1-VL2-L2-VL3-L3-VH3-L4-VH2-L5-VH1-CL-CH1; VL1-L1-VL2-L2-VL3-L3-VH3-L4-VH2-L5-VH1-L6-CL-CH1; VL1-L1-VL2-L2-VL3-L3-VH3-L4-VH2-L5-VH1-L6-CL-L7-CH1; VH1-L1-VH2-L2-VH3-L3-VL3-L4-VL2-L5-VL1-CH1-CL; VH1-L1-VH2-L2-VH3-L3-VL3-L4-VL2-L5-VL1-L6-CH1-CL; VH1-L1-VH2-L2-VH3-L3-VL3-L4-VL2-L5-VL1-L6-CH1-L7-CL; VH1-L1-VH2-L2-VH3-L3-VL3-L4-VL2-L5-VL1-CL-CH1; VH1-L1-VH2-L2-VH3-L3-VL3-L4-VL2-L5-VL1-L6-CL-CH1; VH1-L1-VH2-L2-VH3-L3-VL3-L4-VL2-L5-VL1-L6-CL-L7-CH1; VL1-L1-VH2-L2-VL3-L3-VH3-L4-VL2-L5-VH1-CH1-CL; VL1-L1-VH2-L2-VL3-L3-VH3-L4-VL2-L5-VH1-L6-CH1-CL; VH1-L1-VL2-L2-VH3-L3-VL3-L4-VH2-L5-VL1-CH1-CL; VH1-L1-VL2-L2-VH3-L3-VL3-L4-VH2-L5-VL1-L6-CH1-CL; VH1-L1-VL2-L2-VH3-L3-VL3-L4-VL2-L5-VL1-L6-CH1-L7-CL; VH1-L1-VL2-L2-VH3-L3-VL3-L4-VL2-L5-VL1-CL-CH1; VH1-L1-VL2-L2-VH3-L3-VL3-L4-VL2-L5-VL1-L6-CL-CH1; or VH1-L1-VL2-L2-VL3-L3-VH3-L4-VH2-L5-VL1-L6-CL-L7-CH1; wherein VL1 is a first immuno globulin light chain variable region; VL2 is a second immunoglobulin light chain variable region; VL3 is a third immunoglobulin light chain variable region; VH1 is a first immunoglobulin heavy chain variable region; VH2 is a second immunoglobulin heavy chain variable region; VH3 is a third immunoglobulin heavy chain variable region; CH1 is a heavy chain constant region 1; CL is a light chain constant region; and L1, L2, L3, L4, L5, L6 and L7 are amino acid linkers.

In some aspects, the antigen binding polypeptide complex as defined herein further comprises at least one CH1 region and/or CL region, which is optionally positioned at the carboxy terminus of the first polypeptide and/or second polypeptide. For example, the carboxy terminus of the first polypeptide and/or second polypeptide may comprise a CH1 region. For example, the carboxy terminus of the first polypeptide and/or second polypeptide may comprise a CL region. For example, the carboxy terminus of the first polypeptide and/or second polypeptide may comprise both a CH1 and a CL region. In some aspects, the carboxy terminus of the first polypeptide and/or second polypeptide comprises the structure CH1-CL. In some aspects, the carboxy terminus of the first polypeptide and/or second polypeptide comprises the structure CL-CH1. The CH1 region and/or CL region can be linked to the first polypeptide and/or second polypeptide via one or more amino acid linker. When both the CH1 region and CL region are present, they can be linked to each other via one or more amino acid linker. For example, the antigen binding complex may comprise a first polypeptide and a second polypeptide; wherein the first polypeptide has a structure represented by VL1-VL2-VL3-VH3-VH2-VH1-CH1; VL1-VL2-VL3-VH3-VH2-VH1-CL; VL1-VL2-VL3-VH3-VH2-VH1-CH1-CL; VL1-VL2-VL3-VH3-VH2-VH1-CL-CH1; VH1-VH2-VH3-VL3-VL2-VL1-CH1; VH1-VH2-VH3-VL3-VL2-VL1-CL; VH1-VH2-VH3-VL3-VL2-VL1-CH1-CL; VH1-VH2-VH3-VL3-VL2-VL1-CL-CH1; VL1-VH2-VL3-VH3-VL2-VH1-CH1; VL1-VH2-VL3-VH3-VL2-VH1-CL; VL1-VH2-VL3-VH3-VL2-VH1-CH1-CL; VL1-VH2-VL3-VH3-VL2-VH1-CL-CH1; VH1-VL2-VH3-VL3-VH2-VL1-CH1; VH1-VL2-VH3-VL3-VH2-VL1-CL; VH1-VL2-VH3-VL3-VH2-VL1-CH1-CL; VH1-VL2-VH3-VL3-VH2-VL1-CL-CH1; VL1-VL2-VH3-VL3-VH2-VH1-CH1; VL1-VL2-VH3-VL3-VH2-VH1-CL; VL1-VL2-VH3-VL3-VH2-VH1-CH1-CL; VL1-VL2-VH3-VL3-VH2-VH1-CL-CH1; VH1-VH2-VL3-VH3-VL2-VL1-CH1; VH1-VH2-VL3-VH3-VL2-VL1-CL; VH1-VH2-VL3-VH3-VL2-VL1-

CH1-CL; VH1-VH2-VL3-VH3-VL2-VL1-CL-CH1; VL1-VH2-VH3-VL3-VL2-VH1-CH1; VL1-VH2-VH3-VL3-VL2-VH1-CL; VL1-VH2-VH3-VL3-VL2-VH1-CH1-CL; VL1-VH2-VH3-VL3-VL2-VH1-CL-CH1; VH1-VL2-VL3-VH3-VH2-VL1-CH1; VH1-VL2-VL3-VH3-VH2-VL1-CL; VH1-VL2-VL3-VH3-VH2-VL1-CH1-CL; VH1-VL2-VL3-VH3-VH2-VL1-CL-CH1; VL1-L1-VL2-L2-VL3-L3-VH3-L4-VH2-L5-VH1-CH1; VL1-L1-VL2-L2-VL3-L3-VH3-L4-VH2-L5-VH1-L6-CH1; VL1-L1-VL2-L2-VL3-L3-VH3-L4-VH2-L5-VH1-CL; VL1-L1-VL2-L2-VL3-L3-VH3-L4-VH2-L5-VH1-L6-CL; VL1-L1-VL2-L2-VL3-L3-VH3-L4-VH2-L5- VH1-CH1-CL; VL1-L1-VL2-L2-VL3-L3-VH3-L4-VH2-L5-VH1-L6-CH1-CL; VL1-L1-VL2-L2-VL3-L3-VH3-L4-VH2- L5-VH1-L6-CH1-L7-CL; VL1-L1-VL2-L2-VL3-L3-VH3-L4-VH2-L5-VH1-CL-CH1; VL1-L1-VL2-L2-VL3-L3-VH3- L4-VH2-L5-VH1-L6-CL-CH1; VL1-L1-VL2-L2-VL3-L3-VH3-L4-VH2-L5-VH1-L6-CL-L7-CH1; VH1-L1-VH2-L2-VH3-L3-VL3-L4-VL2-L5-VL1-CH1; VH1-L1-VH2-L2-VH3-L3-VL3-L4-VL2-L5-VL1-L6-CH1; VH1-L1-VH2-L2-VH3-L3-VL3-L4-VL2-L5-VL1-CL; VH1-L1-VH2-L2-VH3-L3-VL3-L4-VL2-L5-VL1-L6-CL; VH1-L1-VH2-L2- VH3-L3-VL3-L4-VL2-L5-VL1-CH1-CL; VH1-L1-VH2-L2-VH3-L3-VL3-L4-VL2-L5-VL1-L6-CH1-CL; VH1-L1-VH2- L2-VH3-L3-VL3-L4-VL2-L5-VL1-L6-CH1-L7-CL; VH1-L1-VH2-L2-VH3-L3-VL3-L4-VL2-L5-VL1-CL-CH1; VH1- L1-VH2-L2-VH3-L3-VL3-L4-VL2-L5-VL1-L6-CL-CH1; VH1-L1-VH2-L2-VH3-L3-VL3-L4-VL2-L5-VL1-L6-CL- L7-CH1; VL1-L1-VH2-L2-VL3-L3-VH3-L4-VL2-L5-VH1-CH1; VL1-L1-VH2-L2-VL3-L3-VH3-L4-VL2-L5-VH1-L6-CH1; VL1-L1-VH2-L2-VL3-L3-VH3-L4-VL2-L5-VH1-CL; VL1-L1-VH2-L2-VL3-L3-VH3-L4-VL2-L5-VH1-L6-CL; VL1-L1-VH2-L2-VL3-L3-VH3-L4-VL2-L5-VH1-CH1-CL; VL1-L1-VH2-L2-VL3-L3-VH3-L4-VL2-L5-VH1-L6-CH1-CL; VL1-L1-VH2-L2-VL3-L3-VH3-L4- VL2-L5-VH1-CL-CH1; VL1-L1-VH2-L2-VL3-L3-VH3-L4-VL2-L5-VH1-L6-CL-CH1; VL1-L1-VH2-L2-VL3-L3-VH3-L4-VL2-L5-VH1-L6-CL-L7-CH1; VH1-L1-VL2-L2-VH3-L3-VL3-L4-VH2-L5-VL1-CH1; VH1-L1-VL2-L2-VH3-L3-VL3-L4-VH2-L5-VL1-L6-CH1; VH1-L1-VL2-L2-VH3-L3-VL3-L4-VH2-L5-VL1-CL; VH1-L1-VL2-L2-VH3-L3-VL3-L4-VH2-L5-VL1-L6-CL; VH1-L1-VL2-L2-VH3-L3-VL3-L4-VH2-L5-VL1-CH1-CL; VH1-L1-VL2- L2-VH3-L3-VL3-L4-VH2-L5-VL1-L6-CH1-CL; VH1-L1-VL2-L2-VH3-L3-VL3-L4-VH2-L5-VL1-L6-CH1-L7-CL; VH1-L1- VL2-L2-VH3-L3-VL3-L4-VH2-L5-VL1-CL-CH1; VH1-L1-VL2-L2-VH3-L3-VL3-L4-VH2-L5-VL1-L6-CL-CH1; VH1- L1-VL2-L2-VH3-L3-VL3-L4-VH2-L5-VL1-L6-CL-L7-CH1; VL1-L1-VL2-L2-VH3-L3-VL3-L4-VH2-L5-VH1-CH1; VL1-L1-VL2-L2-VH3-L3-VL3-L4-VH2-L5-VH1-L6-CH1; VL1-L1-VL2-L2-VH3-L3-VL3-L4-VH2-L5-VH1-CL; VL1-L1-VL2-L2-VH3-L3-VL3-L4-VH2-L5-VH1-L6-CL; VL1-L1-VL2-L2-VH3-L3-VL3-L4-VH2-L5-VH1-CH1-CL; VL1-L1-VL2-L2-VH3-L3-VL3-L4-VH2-L5-VH1-L6-CH1-CL; VL1-L1-VL2-L2-VH3-L3-VL3-L4-VH2-L5-VH1-L6-CH1-L7-CL; VL1-L1-VL2-L2-VH3-L3-VL3-L4-VH2- L5-VH1-L6-CL-CH1; VL1-L1-VL2-L2-VH3-L3-VL3-L4-VH2-L5-VH1-L6-CL-L7-CH1; VH1-L1-VH2-L2-VL3-L3- VH3-L4-VL2-L5-VL1-CH1; VH1-L1-VH2-L2-VL3-L3-VH3-L4-VL2-L5-VL1-L6-CH1; VH1-L1-VH2-L2-VL3-L3-VH3- L4-VL2-L5-VL1-CL; VH1-L1-VH2-L2-VL3-L3-VH3-L4-VL2-L5-VL1-L6-CL; VH1-L1-VH2-L2-VL3-L3-VH3- L4-VL2-L5-VL1-CH1-CL; VH1-L1-VH2-L2-VL3-L3-VH3- L4-VL2-L5-VL1-L6-

VL2-L5-VL1-L6-CH1-L7-CL; VH1-L1-VH2-L2-VL3-L3-VH3-L4-VL2-L5-VL1-CL-CH1; VH1-L1-VH2- L2-VL3-L3-VH3-L4-VL2-L5-VL1-L6-CL-CH1; VH1-L1-VH2-L2-VL3-L3-VH3-L4-VL2-L5-VL1-L6-CL-L7-CH1; VL1-L1-VH2-L2-VH3-L3-VL3-L4-VL2-L5-VH1-CH1; VL1-L1-VH2-L2-VH3-L3-VL3-L4-VL2-L5-VH1-L6-CH1; VL1-L1-VH2-L2-VH3-L3-VL3-L4-VL2-L5-VH1-CL; VL1-L1-VH2-L2-VH3-L3-VL3-L4-VL2-L5-VH1-L6-CL; VL1-L1-VH2-L2-VH3-L3-VL3-L4-VL2-L5-VH1-CH1-CL; VL1-L1-VH2-L2-VH3-L3-VL3-L4-VL2-L5-VH1-L6-CH1-CL; VL1-L1-VH2-L2-VH3-L3-VL3-L4-VL2-L5-VH1-L6-CH1-L7-CL; VL1-L1-VH2-L2-VH3-L3-VL3-L4-VL2-L5-VH1-CL-CH1; VL1-L1-VH2-L2-VH3-L3-VL3-L4-VL2-L5-VH1-L6-CL-CH1; VL1-L1-VH2-L2-VH3-L3-VL3-L4-VL2- L5-VH1-L6-CL-L7-CH1; VH1-L1-VL2-L2-VL3-L3-VH3-L4-VH2-L5-VL1-CH1; VH1-L1-VL2-L2-VL3-L3-VH3-L4-VH2-L5-VL1-L6-CH1; VH1-L1-VL2-L2-VL3-L3-VH3-L4-VH2-L5-VL1-CL; VH1-L1-VL2-L2-VL3-L3-VH3-L4-VH2-L5-VL1-L6-CL; VH1-L1-VL2-L2-VL3-L3-VH3-L4-VH2-L5-VL1-CH1-CL; VH1-L1-VL2-L2-VL3-L3-VH3- L4-VH2-L5-VL1-L6-CH1-CL; VH1-L1-VL2-L2-VL3-L3-VH3-L4-VH2-L5-VL1-L6-CH1-L7-CL; VH1-L1-VL2-L2- VL3-L3-VH3-L4-VH2-L5-VL1-CL-CH1; VH1-L1-VL2-L2-VL3-L3-VH3-L4-VH2-L5-VL1-L6-CL-CH1; or VH1-L1-VL2-L2-VL3-L3-VH3-L4-VH2-L5-VL1-L6-CL-L7-CH1; wherein the second polypeptide has a structure represented by VL4-VH4-CH1; VL4-VH4-CL; VL4-VH4-CH1-CL; VL4-VH4-CL-CH1; VH4-VL4-CH1; VH4-VL4-CL; VH4-VL4-CH1-CL; VH4-VL4-CL-CH1; VL4-L8-VH4-CH1; VL4-L8-VH4-CL; VL4-L8-VH4-CH1-CL; VL4-L8-VH4-CL-CH1; VH4-L8-VL4-CH1; VH4-L8-VL4-CL; VH4-L8-VH4-CH1-CL; VH4-L8-VH4-CL-CH1; VL4-VL5-VH5-VH4-CH1; VL4-VL5-VH5-VH4-CL; VL4-VL5-VH5-VH4-CH1-CL; VL4-VL5-VH5-VH4-CL-CH1; VH4-VH5-VL5-VL4-CH1; VH4-VH5-VL5-VL4-CL; VH4-VH5-VL5-VL4-CH1-CL; VH4-VH5-VL5-VL4-CL-CH1; VL4-L8-VL5-L9-VH5-L10-VH4-CH1; VL4-L8-VL5-L9-VH5-L10-VH4-CL; VL4-L8-VL5-L9-VH5-L10-VH4-CH1-CL; VL4-L8-VL5-L9-VH5-L10-VH4-CL-CH1; VH4-L8-VH5-L9-VL5-L10-VL4-CH1; VH4-L8-VH5-L9-VL5-L10-VL4-CL; VH4-L8-VH5-L9-VL5-L10-VL4-CH1-CL; VH4-L8-VH5-L9-VL5-L10-VL4-CL-CH1; VL4-VL5-VL6-VH6-VH5-VH4-CH1; VL4-VL5-VL6-VH6-VH5-VH4-CL; VL4-VL5-VL6-VH6-VH5-VH4-CH1-CL; VL4-VL5-VL6-VH6-VH5-VH4-CL-CH1; VH4-VH5-VH6-VL6-VL5-VL4-CH1; VH4-VH5-VH6-VL6-VL5-VL4-CL; VH4-VH5-VH6-VL6-VL5-VL4-CH1-CL; VH4-VH5-VH6-VL6-VL5-VL4-CL-CH1; VL4-VH5-VL6-VH6-VL5-VH4-CH1; VL4-VH5-VL6-VH6-VL5-VH4-CL; VL4-VH5-VL6-VH6-VL5-VH4-CH1-CL; VH4-VL5-VH6-VL6-VH5-VL4-CH1; VH4-VL5-VH6-VL6-VH5-VL4-CL; VH4-VL5-VH6-VL6-VH5-VL4-CH1-CL; VL4-VL5-VH6-VL6-VH5-VH4-CH1; VL4-VL5-VH6-VL6-VH5-VH4-CL; VL4-VL5-VH6-VL6-VH5-VH4-CH1-CL; VL4-VL5-VH6-VL6-VH5-VH4-CL-CH1; VH4-VH5-VL6-VH6-VL5-VL4-CH1; VH4-VH5-VL6-VH6-VL5-VL4-CL; VH4-VH5-VL6-VH6-VL5-VL4-CH1-CL; VH4-VH5-VL6-VH6-VL5-VL4-CL-CH1; VL4-VH5-VH6-VL6-VL5-VH4-CH1; VL4-VH5-VH6-VL6-VL5-VH4-CL; VL4-VH5-VH6-VL6-VL5-VH4-CH1-CL; VL4-VH5-VH6-VL6-VL5-VH4-CL-CH1; VH4-VL5-VL6-VH6-VH5-VL4-CH1; VH4-VL5-VL6-VH6-VH5-VL4-CL; VH4-VL5-VL6-VH6-VH5-VL4-CH1-CL; VH4-VL5-VL6-VH6-VH5-VL4-CL-CH1; VL4-L8-VL5-L9-VL6-L10-VH6-L11-VH5-L12-VH4-CH1; VL4-L8-VL5-L9-VL6-L10-VH6-L11-VH5-L12-VH4-CL;

VL4-L8-VL5-L9-VL6-L10-VH6-L11-VH5-L12-VH4-CH1-CL; VL4-L8-VL5-L9-VL6-L10-VH6-L11-VH5-L12-VH4-CL-CH1; VH4-L8-VH5-L9-VH6-L10-VL6-L11-VL5-L12-VL4-CH1; VH4-L8-VH5-L9-VH6-L10-VL6-L11-VL5-L12-VL4-CL; VH4-L8-VH5-L9-VH6-L10-VL6-L11-VL5-L12-VL4-CH1-CL; VH4-L8-VH5-L9-VH6-L10-VL6-L11-VL5-L12-VL4-CL-CH1; VL4-L8-VH5-L9-VL6-L10-VH6-L11-VL5-L12-VH4-CH1; VL4-L8-VH5-L9-VL6-L10-VH6-L11-VL5-L12-VH4-CL; VL4-L8-VH5-L9-VL6-L10-VH6-L11-VL5-L12-VH4-CH1-CL; VL4-L8-VH5-L9-VL6-L10-VH6-L11-VL5-L12-VH4-CL-CH1; VH4-L8-VL5-L9-VH6-L10-VL6-L11-VH5-L12-VL4-CH1; VH4-L8-VL5-L9-VH6-L10-VL6-L11-VH5-L11-VL4-CL; VH4-L8-VL5-L9-VH6-L10-VL6-L11-VH5-L12-VL4-CH1-CL; VH4-L8-VL5-L9-VH6-L10-VL6-L11-VH5-L12-VL4-CL-CH1; VL4-L8-VL5-L9-VL6-L10-VH6-L11-VH5-L12-VH4-L13-CH1; VL4-L8-VL5-L9-VL6-L10-VH6-L11-VH5-L12-VH4-L13-CL; VL4-L8-VL5-L9-VL6-L10-VH6-L11-VH5-L12-VH4-L13-CH1-CL; VL4-L8-VL5-L9-VL6-L10-VH6-L11-VH5-L12-VH4-L13-CL-CH1; VH4-L8-VH5-L9-VH6-L10-VL6-L11-VL5-L12-VL4-L13-CH1; VH4-L8-VH5-L9-VH6-L10-VL6-L11-VL5-L12-VL4-L13-CL; VH4-L8-VH5-L9-VH6-L10-VL6-L11-VL5-L12-VL4-L13-CH1-CL; VH4-L8-VH5-L9-VH6-L10-VL6-L11-VL5-L12-VL4-L13-CL-CH1; VL4-L8-VH5-L9-VL6-L10-VH6-L11-VL5-L12-VH4-L13-CH1; VL4-L8-VH5-L9-VL6-L10-VH6-L11-VL5-L12-VH4-L13-CL; VL4-L8-VH5-L9-VL6-L10-VH6-L11-VL5-L12-VH4-L13-CH1-CL; VL4-L8-VH5-L9-VL6-L10-VH6-L11-VL5-L12-VH4-L13-CL-CH1; VH4-L8-VL5-L9-VH6-L10-VL6-L11-VH5-L12-VL4-L13-CH1; VH4-L8-VL5-L9-VH6-L10-VL6-L11-VH5-L12-VL4-L13-CL; VH4-L8-VL5-L9-VH6-L10-VL6-L11-VH5-L12-VL4-L13-CH1-CL; or VH4-L8-VL5-L9-VH6-L10-VL6-L11-VH5-L12-VL4-L13-CL-CH1; VL4-L8-VL5-L9-VH6-L10-VL6-L11-VH5-L12-VH4-CH1; VL4-L8-VL5-L9-VH6-L10-VL6-L11-VH5-L12-VH4-CL; VL4-L8-VL5-L9-VH6-L10-VL6-L11-VH5-L12-VH4-CH1-CL; VL4-L8-VL5-L9-VH6-L10-VL6-L11-VH5-L12-VH4-CL-CH1; VH4-L8-VH5-L9-VL6-L10-VH6-L11-VL5-L12-VL4-CH1; VH4-L8-VH5-L9-VL6-L10-VH6-L11-VL5-L12-VL4-CL; VH4-L8-VH5-L9-VL6-L10-VH6-L11-VL5-L12-VL4-CH1-CL; VH4-L8-VH5-L9-VL6-L10-VH6-L11-VL5-L12-VL4-CL-CH1; VL4-L8-VH5-L9-VH6-L10-VL6-L11-VH5-L12-VL4-L13-CH1; VL4-L8-VL5-L9-VH6-L10-VL6-L11-VH5-L12-VH4-L13-CL; VL4-L8-VL5-L9-VH6-L10-VL6-L11-VH5-L12-VH4-L13-CH1-CL; VL4-L8-VL5-L9-VH6-L10-VL6-L11-VH5-L12-VH4-L13-CL-CH1; VH4-L8-VH5-L9-VL6-L10-VH6-L11-VL5-L12-VL4-L13-CH1; VH4-L8-VH5-L9-VL6-L10-VH6-L11-VL5-L12-VL4-L13-CL; VH4-L8-VH5-L9-VL6-L10-VH6-L11-VL5-L12-VL4-L13-CH1-CL; or VH4-L8-VH5-L9-VL6-L10-VH6-L11-VL5-L12-VL4-L13-CL-CH1; wherein VL1 is a first immunoglobulin light chain variable region; VL2 is a second immunoglobulin light chain variable region; VL3 is a third immunoglobulin light chain variable region; VL4 is a fourth immunoglobulin light chain variable region; VL5 is a fifth immunoglobulin light chain variable region; VL6 is a sixth immunoglobulin light chain variable region; VH1 is a first immunoglobulin heavy chain variable region; VH2 is a second immunoglobulin heavy chain variable region; VH3 is a third immunoglobulin heavy chain variable region; VH4 is a fourth immunoglobulin heavy chain variable region; VH5 is a fifth immunoglobulin heavy chain variable region; VH6 is a sixth immunoglobulin heavy chain variable region; CH1 is a heavy chain constant region 1; CL is a light chain constant region; and L1, L2, L3, L4, L5, L6, L7, L8, L9, L10, L11, L12 and L13 are amino acid linkers. In some aspects, the first polypeptide has the structure represented by VL1-VL2-VL3-VH3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini. In some aspects, the first polypeptide has the structure represented by VL1-VL2-VL3-VH3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker. In some aspects, the first polypeptide has the structure represented by VL1-VL2-VL3-VH3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker. In some aspects, the first polypeptide has the structure represented by VL1-VL2-VL3-VH3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker and the VL4, VL5, VL6, VH4, VH5, and VH6 of the second polypeptide when present are linked to each other via one or more amino acid linker. In some aspects, the first polypeptide has the structure represented by VL1-VL2-VL3-VH3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1, CL, CH1-CL, or CL-CH1 is linked to the carboxy terminus of the first and/or second polypeptide via one or more amino acid linker. In some aspects, the first polypeptide has the structure represented by VL1-VL2-VL3-VH3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; optionally wherein the VL4, VL5, VL6, VH4, VH5, and VH6 of the second polypeptide when present are linked to each other via one or more amino acid linker and the CH1, CL, CH1-CL, or CL-CH1 when present is linked to the carboxy terminus of the first and/or second polypeptide via one or more amino acid linker. In some aspects, the first polypeptide has the structure represented by VL1-VL2-VL3-VH3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, and the CH1, CL, CH1-CL, or CL-CH1 when present is linked to the carboxy terminus of the first and/or second polypeptide via one or more amino acid linker. In some aspects, the first polypeptide has the structure represented by VL1-VL2-VL3-VH3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1 and CL when both present in the first and/or second polypeptide are linked to each other via one or more amino acid linker. In some aspects, the first polypeptide has the structure represented by VL1-VL2-VL3-VH3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VH5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VL1-VL2-VL3-VH3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker; and the CH1 and CL when both present in the first and/or second polypeptide are linked to each other via one or more amino acid linker. In some aspects, the first polypeptide has the structure represented by VL1-VL2-VL3-VH3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VL1-VL2-VL3-VH3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VL5-VH6-VL6-VH5-VL4, VL4-VH5-VL6-VH6-VL5-VH4, VH4-VL5-VH6-VL6-VH5-VL4, VL4-VH5-VH6-VL6-VL5-VH4, VH4-VH5-VL6-VH6-VL5-VL4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VH1-VH2-VH3-VL3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-

VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini. In some aspects, the first polypeptide has the structure represented by VH1-VH2-VH3-VL3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker. In some aspects, the first polypeptide has the structure represented by VH1-VH2-VH3-VL3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker. In some aspects, the first polypeptide has the structure represented by VH1-VH2-VH3-VL3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker and the VL4, VL5, VL6, VH4, VH5, and VH6 of the second polypeptide when present are linked to each other via one or more amino acid linker. In some aspects, the first polypeptide has the structure represented by VH1-VH2-VH3-VL3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1, CL, CH1-CL, or CL-CH1 is linked to the carboxy terminus of the first and/or second polypeptide via one or more amino acid linker. In some aspects, the first polypeptide has the structure represented by VH1-VH2-VH3-VL3-VL2-VL1, and the second polypeptide has the structure represented by VL4-VH4, VH4-VL4, VL4-VL5-VH5-VH4, VH4-VH5-VL5-VL4, VL4-VL5-VL6-VH6-

VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; optionally wherein the VL4, VL5, VL6, VH4, VH5, and VH6 of the second polypeptide when present are linked to each other via one or more amino acid linker and the CH1, CL, CH1-CL, or CL-CH1 when present is linked to the carboxy terminus of the first and/or second polypeptide via one or more amino acid linker. In some aspects, the first polypeptide has the structure represented by VH1-VH2-VH3-VL3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, and the CH1, CL, CH1-CL, or CL-CH1 when present is linked to the carboxy terminus of the first and/or second polypeptide via one or more amino acid linker. In some aspects, the first polypeptide has the structure represented by VH1-VH2-VH3-VL3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1 and CL when both present in the first and/or second polypeptide are linked to each other via one or more amino acid linker. In some aspects, the first polypeptide has the structure represented by VH1-VH2-VH3-VL3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VH1-VH2-VH3-VL3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker; and the CH1 and CL when both present in the first and/or second polypeptide are linked to each other via one or more amino acid linker. In some aspects, the first polypeptide has the structure represented by VH1-VH2-VH3-VL3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VH1-VH2-VH3-VL3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VL1-VH2-VL3-VH3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VH6-VL6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini. In some aspects, the first polypeptide has the structure represented by VL1-VH2-VL3-VH3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker. In some aspects, the first polypeptide has the structure represented by VL1-VH2-VL3-VH3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker. In some aspects, the first polypeptide has the structure represented by VL1-VH2-VL3-VH3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker and the VL4, VL5, VL6, VH4, VH5, and VH6 of the second polypeptide when present are linked to each other via one or more amino acid linker. In some aspects, the first polypeptide has the structure represented by VL1-VH2-VL3-VH3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1, CL, CH1-CL, or CL-CH1 is linked to the carboxy terminus of the first and/or second polypeptide via one or more amino acid linker. In some aspects, the first polypeptide has the structure represented by VL1-VH2-VL3-VH3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; optionally wherein the VL4, VL5, VL6, VH4, VH5, and VH6 of the second polypeptide when present are linked to each other via one or more amino acid linker and the CH1, CL, CH1-CL, or CL-CH1 when present is linked to the carboxy terminus of the first and/or second polypeptide via one or more amino acid linker. In some aspects, the first polypeptide has the structure represented by VL1-VH2-VL3-VH3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-H6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, and the CH1, CL, CH1-CL, or CL-CH1 when present is linked to the carboxy terminus of the first and/or second polypeptide via one or more amino acid linker. In some aspects, the first polypeptide has the structure represented by VL1-VH2-VL3-VH3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1 and CL when both present in the first and/or second polypeptide are linked to each other via one or more amino acid linker. In some aspects, the first polypeptide has the structure represented by VL1-VH2-VL3-VH3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VL1-VH2-VL3-VH3-VL2-VH1, and the second polypep-tide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypep-tide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker; and the CH1 and CL when both present in the first and/or second polypeptide are linked to each other via one or more amino acid linker. In some aspects, the first polypeptide has the structure represented by VL1-VH2-VL3-VH3-VL2-VH1, and the second polypep-tide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypep-tide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first poly-peptide has the structure represented by VL1-VH2-VL3-VH3-VL2-VH1, and the second polypeptide has the struc-ture represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, the CH1, CL, CH1-CL, or CL-CH1 when present is linked to the carboxy terminus of the first and/or second polypeptide via one or more amino acid linker, and the CH1 and CL when both present in the first and/or second poly-peptide are linked to each other via one or more amino acid linker. In some aspects, the first polypeptide has the structure represented by VH1-VL2-VH3-VL3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini. In some aspects, the first polypeptide has the structure represented by VH1-VL2-VH3-VL3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker. In some aspects, the first polypeptide has the structure represented by VL1-VH2-VL3-VH3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker. In some aspects, the first polypeptide has the structure represented by VH1-VL2-VH3-VL3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker and the VL4, VL5, VL6, VH4, VH5, and VH6 of the second polypeptide when present are linked to each other via one or more amino acid linker. In some aspects, the first polypeptide has the structure represented by VH1-VL2-VH3-VL3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1, CL, CH1-CL, or CL-CH1 is linked to the carboxy terminus of the first and/or second polypeptide via one or more amino acid linker. In some aspects, the first polypeptide has the structure represented by VH1-VL2-VH3-VL3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VH6-VL6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; optionally wherein the VL4, VL5, VL6, VH4, VH5, and VH6 of the second polypeptide when present are linked to each other via one or more amino acid linker and the CH1, CL, CH1-CL, or CL-CH1 when present is linked to the carboxy terminus of the first and/or second polypeptide via one or more amino acid linker. In some aspects, the first polypeptide has the structure represented by VH1-VL2-VH3-VL3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, and the CH1, CL, CH1-CL, or CL-CH1 when present is linked to the carboxy terminus of the first and/or second polypeptide via one or more amino acid linker. In some aspects, the first polypeptide has the structure represented by VH1-VL2-VH3-VL3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VH6-VL6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1 and CL when both present in the first and/or second polypeptide are linked to each other via one or more amino acid linker. In some aspects, the first polypeptide has the structure represented by VH1-VL2-VH3-VL3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VH1-VL2-VH3-VL3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker; and the CH1 and CL when both present in the first and/or second polypeptide are linked to each other via one or more amino acid linker. In some aspects, the first polypeptide has the structure represented by VH1-VL2-VH3-

VL3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VL6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VH1-VL2-VH3-VL3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VL1-VL2-VH3-VL3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini. In some aspects, the first polypeptide has the structure represented by VL1-VL2-VH3-VL3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker. In some aspects, the first polypeptide has the structure represented by VL1-VL2-VH3-VL3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-

VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker. In some aspects, the first polypeptide has the structure represented by VL1-VL2-VH3-VL3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker and the VL4, VL5, VL6, VH4, VH5, and VH6 of the second polypeptide when present are linked to each other via one or more amino acid linker. In some aspects, the first polypeptide has the structure represented by VL1-VL2-VH3-VL3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1, CL, CH1-CL, or CL-CH1 is linked to the carboxy terminus of the first and/or second polypeptide via one or more amino acid linker. In some aspects, the first polypeptide has the structure represented by VL1-VL2-VH3-VL3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; optionally wherein the VL4, VL5, VL6, VH4, VH5, and VH6 of the second polypeptide when present are linked to each other via one or more amino acid linker and the CH1, CL, CH1-CL, or CL-CH1 when present is linked to the carboxy terminus of the first and/or second polypeptide via one or more amino acid linker. In some aspects, the first polypeptide has the structure represented by VL1-VL2-VH3-VL3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, and the CH1, CL, CH1-CL, or CL-CH1 when present is linked to the carboxy terminus of the first and/or second polypeptide via one or more amino acid linker. In some aspects, the first polypeptide has the structure represented by VL1-VL2-VH3-VL3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1 and CL when both present in the first and/or second polypeptide are linked to each other via one or more amino acid linker. In some aspects, the first polypeptide has the structure represented by VL1-VL2-VH3-VL3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VL1-VL2-VH3-VL3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VL1-VL2-VH3-VL3-VH2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VH1-VH2-VL3-VH3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini. In some aspects, the first polypeptide has the structure represented by VH1-VH2-VL3-VH3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker. In some aspects, the first polypeptide has the structure represented by VH1-VH2-VL3-VH3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker. In some aspects, the first polypeptide has the structure represented by VH1-VH2-VL3-VH3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker and the VL4, VL5, VL6, VH4, VH5, and VH6 of the second polypeptide when present are linked to each other via one or more amino acid linker. In some aspects, the first polypeptide has the structure represented by VH1-VH2-VL3-VH3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1, CL, CH1-CL, or CL-CH1 is linked to the carboxy terminus of the first and/or second polypeptide via one or more amino acid linker. In some aspects, the first polypeptide has the structure represented by VH1-VH2-VL3-VH3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; optionally wherein the VL4, VL5, VL6, VH4, VH5, and VH6 of the second polypeptide when present are linked to each other via one or more amino acid linker and the CH1, CL, CH1-CL, or CL-CH1 when present is linked to the carboxy terminus of the first and/or second polypeptide via one or more amino acid linker. In some aspects, the first polypeptide has the structure represented by VH1-VH2-VL3-VH3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, and the CH1, CL, CH1-CL, or CL-CH1 when present is linked to the carboxy terminus of the first and/or second polypeptide via one or more amino acid linker. In some aspects, the first polypeptide has the structure represented by VH1-VH2-VL3-VH3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1 and CL when both present in the first and/or second polypeptide are linked to each other via one or more amino acid linker. In some aspects, the first polypeptide has the structure represented by VH1-VH2-VL3-VH3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VH1-VH2-VL3-VH3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker; and the CH1 and CL when both present in the first and/or second polypeptide are linked to each other via one or more amino acid linker. In some aspects, the first polypeptide has the structure represented by VH1-VH2-VL3-VH3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VH1-VH2-VL3-VH3-VL2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VL1-VH2-VH3-VL3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini. In some aspects, the first polypeptide has the structure represented by VL1-VH2-VH3-VL3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker. In some aspects, the first polypeptide has the structure represented by VL1-VH2-VH3-VL3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker. In some aspects, the first polypeptide has the structure represented by VL1-VH2-VH3-VL3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker and the VL4, VL5, VL6, VH4, VH5, and VH6 of the second polypeptide when present are linked to each other via one or more amino acid linker. In some aspects, the first polypeptide has the structure represented by VL1-VH2-VH3-VL3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1, CL, CH1-CL, or CL-CH1 is linked to the carboxy terminus of the first and/or second polypeptide via one or more amino acid linker. In some aspects, the first polypeptide has the structure represented by VL1-VH2-VH3-VL3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; optionally wherein the VL4, VL5, VL6, VH4, VH5, and VH6 of the second polypeptide when present are linked to each other via one or more amino acid linker and the CH1, CL, CH1-CL, or CL-CH1 when present is linked to the carboxy terminus of the first and/or second polypeptide via one or more amino acid linker. In some aspects, the first polypeptide has the structure represented by VL1-VH2-VH3-VL3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, and the CH1, CL, CH1-CL, or CL-CH1 when present is linked to the carboxy terminus of the first and/or second polypeptide via one or more amino acid linker. In some aspects, the first polypeptide has the structure represented by VL1-VH2-VH3-VL3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1 and CL when both present in the first and/or second polypeptide are linked to each other via one or more amino acid linker. In some aspects, the first polypeptide has the structure represented by VL1-VH2-VH3-VL3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VL1-VH2-VH3-VL3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker; and the CH1 and CL when both present in the first and/or second polypeptide are linked to each other via one or more amino acid linker. In some aspects, the first polypeptide has the structure represented by VL1-VH2-VH3-VL3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VL1-VH2-VH3-VL3-VL2-VH1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-

VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VH1-VL2-VL3-VH3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini. In some aspects, the first polypeptide has the structure represented by VH1-VL2-VL3-VH3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker. In some aspects, the first polypeptide has the structure represented by VH1-VL2-VL3-VH3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker. In some aspects, the first polypeptide has the structure represented by VH1-VL2-VL3-VH3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker and the VL4, VL5, VL6, VH4, VH5, and VH6 of the second polypeptide when present are linked to each other via one or more amino acid linker. In some aspects, the first polypeptide has the structure represented by VH1-VL2-VL3-VH3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1, CL, CH1-CL, or CL-CH1 is linked to the carboxy terminus of the first and/or second polypeptide via one or more amino acid linker. In some aspects, the first polypeptide has the structure represented by VH1-VL2-VL3-VH3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; optionally wherein the VL4, VL5, VL6, VH4, VH5, and VH6 of the second polypeptide when present are linked to each other via one or more amino acid linker and the CH1, CL, CH1-CL, or CL-CH1 when present is linked to the carboxy terminus of the first and/or second polypeptide via one or more amino acid linker. In some aspects, the first polypeptide has the structure represented by VH1-VL2-VL3-VH3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, and the CH1, CL, CH1-CL, or CL-CH1 when present is linked to the carboxy terminus of the first and/or second polypeptide via one or more amino acid linker. In some aspects, the first polypeptide has the structure represented by VH1-VL2-VL3-VH3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; and the CH1 and CL when both present in the first and/or second polypeptide are linked to each other via one or more amino acid linker. In some aspects, the first polypeptide has the structure represented by VH1-VL2-VL3-VH3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VH1-VL2-VL3-VH3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker; and the CH1 and CL when both present in the first and/or second polypeptide are linked to each other via one or more amino acid linker. In some aspects, the first polypeptide has the structure represented by VH1-VL2-VL3-VH3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL4, VL5, VL6, VH4, VH5, and VH6 of the second polypeptide when present are linked to each other via one or more amino acid linker; the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker. In some aspects, the first polypeptide has the structure represented by VH1-VL2-VL3-VH3-VH2-VL1, and the second polypeptide has the structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4, or VH4-VL5-VL6-VH6-VH5-VL4; wherein the first polypeptide and second polypeptide each comprise a CH1, CL, CH1-CL, or CL-CH1 at their carboxy termini; wherein the VL1, VL2, VL3, VH1, VH2, and VH3 of the first polypeptide are linked to each other via one or more amino acid linker, the VL4, VL5, VL6, VH4, VH5, and VH6 of the second polypeptide when present are linked to each other via one or more amino acid linker, the CH1, CL, CH1-CL, or CL-CH1 when present is linked to the carboxy terminus of the first and/or second polypeptide via one or more amino acid linker, and the CH1 and CL when both present in the first and/or second polypeptide are linked to each other via one or more amino acid linker.

In some aspects, the antigen binding polypeptide complex as defined herein further comprises at least two of an Fc region, a CH1 region and a CL region which is optionally positioned at the carboxy terminus of the first polypeptide and/or second polypeptide. For example, the carboxy terminus of the first polypeptide and/or second polypeptide may comprise the structure CH1-Fc. For example, the carboxy terminus of the first polypeptide and/or second polypeptide may comprise the structure CL-Fc. For example, the carboxy terminus of the first polypeptide and/or second polypeptide may comprise the structure CL-CH1-Fc. For example, the carboxy terminus of the first polypeptide and/or second polypeptide may comprise the structure CH1-CL-Fc. In some aspects, the first polypeptide may comprise at its C-terminus at least two of an Fc region, a CH1 region and a CL region and the second polypeptide may comprise at its C-terminus an Fc region. The Fc region, CH1 region and/or CL region can be linked to the first polypeptide and/or second polypeptide via at least one amino acid linker. The Fc region, CH1 region and/or CL region can be linked to each other via at least one amino acid linker. For example, the antigen binding complex may comprise a first polypeptide and a second polypeptide; wherein the first polypeptide has a structure represented by VL1-VL2-VL3-VH3-VH2-VH1-CH1-Fc; VH1-VH2-VH3-VL3-VL2-VL1-CH1-Fc; VL1-VH2-VL3-VH3-VL2-VH1-CH1-Fc; VH1-VL2-VH3-VL3-VH2-VL1-CH1-Fc; VL1-VL2-VH3-VL3-VH2-VH1-CH1-Fc; VH1-VH2-VL3-VH3-VL2-VL1-CH1-Fc; VL1-VH2-VH3-VL3-VL2-VH1-CH1-Fc; VH1-VL2-VL3-VH3-VH2-VL1-CH1-Fc; VL1-VL2-VL3-VH3-VH2-VH1-CL-Fc; VH1-VH2-VH3-VL3-VL2-VL1-CL-Fc; VL1-VH2-VL3-VH3-VL2-VH1-CL-Fc; VH1-VL2-VH3-VL3-VH2-VL1-CL-Fc; VL1-VL2-VH3-VL3-VH2-VH1-CL-Fc; VH1-VH2-VL3-VH3-VL2-VL1-CL-Fc; VL1-VH2-VH3-VL3-VL2-VH1-CL-Fc; VH1-VL2-VL3-VH3-VH2-VL1-CL-Fc; VL1-VL2-VL3-VH3-VH2-VH1-CH1-CL-Fc; VH1-VH2-VH3-VL3-VL2-VL1-CH1-CL-Fc; VL1-VH2-VL3-VH3-VL2-VH1-CH1-CL-Fc; VH1-VL2-VH3-VL3-VH2-VL1-CH1-CL-Fc; VL1-VL2-VH3-VL3-VH2-VH1-CH1-CL-Fc; VH1-VH2-VL3-VH3-VL2-VL1-CH1-CL-Fc; VL1-VH2-VH3-VL3-VL2-VH1-CH1-CL-Fc; VH1-VL2-VL3-VH3-VH2-VL1-CH1-CL-Fc; VL1-VL2-VL3-VH3-VH2-VH1-CL-CH1-Fc; VH1-VH2-VH3-VL3-VL2-VL1-CL-CH1-Fc; VL1-VH2-VL3-VH3-VL2-VH1-CL-CH1-Fc; VH1-VL2-VH3-VL3-VH2-VL1-CL-CH1-Fc; VL1-VL2-VH3-VL3-VH2-VH1-CL-CH1-Fc; VH1-VH2-VL3-VH3-VL2-VL1-CL-CH1-Fc; VL1-VH2-VH3-VL3-VL2-VH1-CL-CH1-Fc; VH1-VL2-VL3-VH3-VH2-VL1-CL-CH1-Fc; VL1-L1-VL2-L2-VL3-L3-VH3-L4-VH2-L5-VH1-CH1-Fc; VH1-L1-VH2-L2-VH3-L3-VL3-L4-VL2-L5-VL1-CH1-Fc; VL1-L1-VH2-L2-VL3-L3-VH3-L4-VL2-L5-VH1-CH1-Fc; VH1-L1-VL2-L2-VH3-L3-VL3-L4-VH2-L5-VL1-CH1-Fc; VL1-L1-VL2-L2-VH3-L3-VL3-L4-VH2-L5-VH1-CH1-Fc; VH1-L1-VH2-L2-VL3-L3-VH3-L4-VL2-L5-VL1-CH1-Fc; VL1-L1-VH2-L2-VH3-L3-VL3-L4-VL2-L5-VH1-CH1-Fc; VL1-L1-VL2-L2-VL3-L3-VH3-L4-VH2-L5-VH1-CL-Fc; VH1-L1-VH2-L2-VH3-L3-VL3-L4-VL2-L5-VL1-CL-Fc; VL1-L1-

VH2-L2-VL3-L3-VH3-L4-VL2-L5-VH1-CL-Fc; VH1-L1-VL2-L2-VH3-L3-VL3-L4-VH2-L5-VL1-CL-Fc; VL1-L1-VL2-L2-VH3-L3-VL3-L4-VH2-L5-VH1-CL-Fc; VH1-L1-VH2-L2-VL3-L3-VH3-L4-VL2-L5-VL1-CL-Fc; VL1-L1-VH2-L2-VH3-L3-VL3-L4-VL2-L5-VH1-CL-Fc; VL1-L1-VL2-L2-VL3-L3-VH3-L4-VH2-L5-VH1-CH1-CL-Fc; VH1-L1-VH2-L2-VH3-L3-VL3-L4-VL2-L5-VL1-CH1-CL-Fc; VL1-L1-VH2-L2-VL3-L3-VH3-L4-VL2-L5-VH1-CH1-CL-Fc; VH1-L1-VL2-L2-VH3-L3-VL3-L4-VH2-L5-VL1-CH1-CL-Fc; VL1-L1-VL2-L2-VH3-L3-VL3-L4-VH2-L5-VH1-CH1-CL-Fc; VH1-L1-VH2-L2-VL3-L3-VH3-L4-VL2-L5-VL1-CH1-CL-Fc; VL1-L1-VH2-L2-VH3-L3-VL3-L4-VL2-L5-VH1-CH1-CL-Fc; VL1-L1-VL2-L2-VL3-L3-VH3-L4-VH2-L5-VH1-CL-CH1-Fc; VH1-L1-VH2-L2-VH3-L3-VL3-L4-VL2-L5-VL1-CL-CH1-Fc; VL1-L1-VH2-L2-VL3-L3-VH3-L4-VL2-L5-VH1-CL-CH1-Fc; VH1-L1-VL2-L2-VH3-L3-VL3-L4-VH2-L5-VL1-CL-CH1-Fc; VL1-L1-VL2-L2-VH3-L3-VL3-L4-VH2-L5-VH1-CL-CH1-Fc; VH1-L1-VH2-L2-VL3-L3-VH3-L4-VL2-L5-VL1-CL-CH1-Fc; VL1-L1-VH2-L2-VH3-L3-VL3-L4-VL2-L5-VH1-CL-CH1-Fc; or VH1-L1-VL2-L2-VL3-L3-VH3-L4-VH2-L5-VL1-CL-CH1-Fc; wherein the second polypeptide has a structure represented by Fc; VL4-VH4-CH1-Fc; VL4-VH4-CL-Fc; VL4-VH4-CH1-CL-Fc; VL4-VH4-CL-CH1-Fc; VH4-VL4-CH1-Fc; VH4-VL4-CL-Fc; VH4-VL4-CH1-CL-Fc; VH4-VL4-CL-CH1-Fc; VL4-L6-VH4-CH1-Fc; VL4-L6-VH4-CL-Fc; VL4-L6-VH4-CH1-CL-Fc; VL4-L6-VH4-CL-CH1-Fc; VH4-L6-VL4-CH1-Fc; VH4-L6-VL4-CL-Fc; VH4-L6-VL4-CH1-CL-Fc; VH4-L6-VL4-CL-CH1-Fc; VL4-VL5-VH5-VH4-CH1-Fc; VL4-VL5-VH5-VH4-CL-Fc; VL4-VL5-VH5-VH4-CH1-CL-Fc; VL4-VL5-VH5-VH4-CL-CH1-Fc; VH4-VH5-VL5-VL4-CH1-Fc; VH4-VH5-VL5-VL4-CL-Fc; VH4-VH5-VL5-VL4-CH1-CL-Fc; VH4-VH5-VL5-VL4-CL-CH1-Fc; VL4-L6-VL5-L7-VH5-L8-VH4-CH1-Fc; VL4-L6-VL5-L7-VH5-L8-VH4-CL-Fc; VL4-L6-VL5-L7-VH5-L8-VH4-CH1-CL-Fc; VL4-L6-VL5-L7-VH5-L8-VH4-CL-CH1-Fc; VH4-L6-VH5-L7-VL5-L8-VL4-CH1-Fc; VH4-L6-VH5-L7-VL5-L8-VL4-CL-Fc; VH4-L6-VH5-L7-VL5-L8-VL4-CH1-CL-Fc; VH4-L6-VH5-L7-VL5-L8-VL4-CL-CH1-Fc; VL4-VL5-VL6-VH6-VH5-VH4-CH1-Fc; VL4-VL5-VL6-VH6-VH5-VH4-CL-Fc; VL4-VL5-VL6-VH6-VH5-VH4-CH1-CL-Fc; VL4-VL5-VL6-VH6-VH5-VH4-CL-CH1-Fc; VH4-VH5-VH6-VL6-VL5-VL4-CH1-Fc; VH4-VH5-VH6-VL6-VL5-VL4-CL-Fc; VH4-VH5-VH6-VL6-VL5-VL4-CH1-CL-Fc; VH4-VH5-VH6-VL6-VL5-VL4-CL-CH1-Fc; VL4-VH5-VL6-VH6-VL5-VH4-CH1-Fc; VL4-VH5-VL6-VH6-VL5-VH4-CL-Fc; VL4-VH5-VL6-VH6-VL5-VH4-CH1-CL-Fc; VL4-VH5-VL6-VH6-VL5-VH4-CL-CH1-Fc; VH4-VL5-VH6-VL6-VH5-VL4-CH1-Fc; VH4-VL5-VH6-VL6-VH5-VL4-CL-Fc; VH4-VL5-VH6-VL6-VH5-VL4-CH1-CL-Fc; VH4-VL5-VH6-VL6-VH5-VL4-CL-CH1-Fc; VL4-VL5-VH6-VL6-VH5-VH4-CH1-Fc; VL4-VL5-VH6-VL6-VH5-VH4-CL-Fc; VL4-VL5-VH6-VL6-VH5-VH4-CH1-CL-Fc; VL4-VL5-VH6-VL6-VH5-VH4-CL-CH1-Fc; VH4-VH5-VL6-VH6-VL5-VL4-CH1-Fc; VH4-VH5-VL6-VH6-VL5-VL4-CL-Fc; VH4-VH5-VL6-VH6-VL5-VL4-CH1-CL-Fc; VH4-VH5-VL6-VH6-VL5-VL4-CL-CH1-Fc; VL4-VH5-VH6-VL6-VL5-VH4-CH1-Fc; VL4-VH5-VH6-VL6-VL5-VH4-CL-Fc; VL4-VH5-VH6-VL6-VL5-VH4-CH1-CL-Fc; VL4-VH5-VH6-VL6-VL5-VH4-CL-CH1-Fc; VH4-VL5-VL6-VH6-VH5-VL4-CH1-Fc; VH4-VL5-VL6-VH6-VH5-VL4-CL-Fc; VH4-VL5-VL6-VH6-VH5-VL4-CH1-CL-Fc; VH4-VL5-VL6-VH6-VH5-VL4-CL-CH1-Fc; VL4-L6-VL5-L7-

VL6-L8-VH6-L9-VH5-L10-VH4-CH1-Fc; VL4-L6-VL5-L7-VL6-L8-VH6-L9-VH5-L10-VH4-CL-Fc; VL4-L6-VL5-L7-VL6-L8-VH6-L9-VH5-L10-VH4-CH1-CL-Fc; VL4-L6-VL5-L7-VL6-L8-VH6-L9-VH5-L10-VH4-CL-CH1-Fc; VH4-L6-VH5-L7-VH6-L8-VL6-L9-VL5-L10-VL4-CH1-Fc; VH4-L6-VH5-L7-VH6-L8-VL6-L9-VL5-L10-VL4-CL-Fc; VH4-L6-VH5-L7-VH6-L8-VL6-L9-VL5-L10-VL4-CH1-CL-Fc; VH4-L6-VH5-L7-VH6-L8-VL6-L9-VL5-L10-VL4-CL-CH1-Fc; VL4-L6-VH5-L7-VL6-L8-VH6-L9-VL5-L10-VH4-CH1-Fc; VL4-L6-VH5-L7-VL6-L8-VH6-L9-VL5-L10-VH4-CL-Fc; VL4-L6-VH5-L7-VL6-L8-VH6-L9-VL5-L10-VH4-CH1-CL-Fc; VL4-L6-VH5-L7-VL6-L8-VH6-L9-VL5-L10-VH4-CL-CH1-Fc; VH4-L6-VL5-L7-VH6-L8-VL6-L9-VH5-L10-VL4-CH1-Fc; VH4-L6-VL5-L7-VH6-L8-VL6-L9-VH5-L10-VL4-CL-Fc; VH4-L6-VL5-L7-VH6-L8-VL6-L9-VH5-L10-VL4-CH1-CL-Fc; VH4-L6-VL5-L7-VH6-L8-VL6-L9-VH5-L10-VL4-CL-CH1-Fc; VL4-L6-VL5-L7-VH6-L8-VL6-L9-VH5-L10-VH4-CH1-Fc; VL4-L6-VL5-L7-VH6-L8-VL6-L9-VH5-L10-VH4-CL-Fc; VL4-L6-VL5-L7-VH6-L8-VL6-L9-VH5-L10-VH4-CH1-CL-Fc; VL4-L6-VL5-L7-VH6-L8-VL6-L9-VH5-L10-VH4-CL-CH1-Fc; VH4-L6-VH5-L7-VL6-L8-VH6-L9-VL5-L10-VL4-CH1-Fc; VH4-L6-VH5-L7-VL6-L8-VH6-L9-VL5-L10-VL4-CL-Fc; VH4-L6-VH5-L7-VL6-L8-VH6-L9-VL5-L10-VL4-CH1-CL-Fc; VH4-L6-VH5-L7-VL6-L8-VH6-L9-VL5-L10-VL4-CL-CH1-Fc; VL4-L6-VH5-L7-VH6-L8-VL6-L9-VL5-L10-VH4-CH1-Fc; VL4-L6-VH5-L7-VH6-L8-VL6-L9-VL5-L10-VH4-CL-Fc; VL4-L6-VH5-L7-VH6-L8-VL6-L9-VL5-L10-VH4-CH1-CL-Fc; VL4-L6-VH5-L7-VH6-L8-VL6-L9-VL5-L10-VH4-CL-CH1-Fc; VH4-L6-VL5-L7-VL6-L8-VH6-L9-VH5-L10-VH4-L11-CH1-Fc; VL4-L6-VL5-L7-VL6-L8-VH6-L9-VH5-L10-VH4-L11-CL-Fc; VL4-L6-VL5-L7-VL6-L8-VH6-L9-VH5-L10-VH4-L11-CH1-CL-Fc; VL4-L6-VL5-L7-VL6-L8-VH6-L9-VH5-L10-VH4-L11-CL-CH1-Fc; VH4-L6-VH5-L7-VH6-L8-VL6-L9-VL5-L10-VL4-L11-CH1-Fc; VH4-L6-VH5-L7-VH6-L8-VL6-L9-VL5-L10-VL4-L11-CL-Fc; VH4-L6-VH5-L7-VH6-L8-VL6-L9-VL5-L10-VL4-L11-CH1-CL-Fc; VH4-L6-VH5-L7-VH6-L8-VL6-L9-VL5-L10-VL4-L11-CL-CH1-Fc; VL4-L6-VH5-L7-VL6-L8-VH6-L9-VL5-L10-VH4-L11-CH1-Fc; VL4-L6-VH5-L7-VL6-L8-VH6-L9-VL5-L10-VH4-L11-CL-Fc; VL4-L6-VH5-L7-VL6-L8-VH6-L9-VL5-L10-VH4-L11-CH1-CL-Fc; VL4-L6-VH5-L7-VL6-L8-VH6-L9-VL5-L10-VH4-L11-CL-CH1-Fc; VH4-L6-VL5-L7-VH6-L8-VL6-L9-VH5-L10-VL4-L11-CH1-Fc; VH4-L6-VL5-L7-VH6-L8-VL6-L9-VH5-L10-VL4-L11-CL-Fc; VH4-L6-VL5-L7-VH6-L8-VL6-L9-VH5-L10-VL4-L11-CH1-CL-Fc; VH4-L6-VL5-L7-VH6-L8-VL6-L9-VH5-L10-VL4-L11-CL-CH1-Fc; VL4-L6-VL5-L7-VH6-L8-VH6-L9-VH5-L10-VH4-L11-CH1-Fc; VL4-L6-VL5-L7-VH6-L8-VH6-L9-VH5-L10-VH4-L11-CL-Fc; VL4-L6-VL5-L7-VH6-L8-VH6-L9-VH5-L10-VH4-L11-CH1-CL-Fc; VL4-L6-VL5-L7-VH6-L8-VH6-L9-VH5-L10-VH4-L11-CL-CH1-Fc; VH4-L6-VH5-L7-VH6-L8-VL6-L9-VL5-L10-VL4-L11-CH1-Fc; VH4-L6-VH5-L7-VH6-L8-VL6-L9-VL5-L10-VL4-L11-CL-Fc; VH4-L6-VH5-L7-VH6-L8-VL6-L9-VL5-L10-VL4-L11-CH1-CL-Fc; VL4-L6-VH5-L7-VL6-L8-VH6-L9-VL5-L10-VH4-L11-CH1-Fc; VL4-L6-VH5-L7-VL6-L8-VH6-L9-VL5-L10-VH4-L11-CL-Fc; VL4-L6-VH5-L7-VL6-L8-VH6-L9-VL5-L10-VH4-L11-CH1-CL-Fc; VL4-L6-VH5-L7-VL6-L8-VH6-L9-VL5-L10-VH4-L11-CL-CH1-Fc; VH4-L6-VL5-L7-VH6-L8-VL6-L9-VH5-L10-VL4-L11-CH1-CL-Fc; VH4-L6-VL5-L7-VH6-L8-VL6-L9-VH5-L10-VL4-L11-CL-CH1-Fc; or VH4-L6-VL5-L7-VL6-L8-VH6-L9-VH5-L10-VL4-L11-CL-CH1-Fc;

VL4-L6-VH5-L7-VH6-L8-VL6-L9-VL5-L10-VH4-L11-CH1-CL-Fc; VL4-L6-VH5-L7-VH6-L8-VL6-L9-VL5-L10-VH4-L11-CL-CH1-Fc; VH4-L6-VL5-L7-VL6-L8-VH6-L9-VH5-L10-VL4-L11-CH1-Fc; VH4-L6-VL5-L7-VL6-L8-VH6-L9-VH5-L10-VL4-L11-CL-Fc; VL4-L6-VH5-L7-VL6-L8-VH6-L9-VH5-L10-VL4-L11-CH1-CL-Fc; or VH4-L6-VL5-L7-VL6-L8-VH6-L9-VH5-L10-VL4-L11-CL-CH1-Fc; wherein VL1 is a first immunoglobulin light chain variable region; VL2 is a second immunoglobulin light chain variable region; VL3 is a third immunoglobulin light chain variable region; VL4 is a fourth immunoglobulin light chain variable region; VL5 is a fifth immunoglobulin light chain variable region; VL6 is a sixth immunoglobulin light chain variable region; VH1 is a first immunoglobulin heavy chain variable region; VH2 is a second immunoglobulin heavy chain variable region; VH3 is a third immunoglobulin heavy chain variable region; VH4 is a fourth immunoglobulin heavy chain variable region; VH5 is a fifth immunoglobulin heavy chain variable region; VH6 is a sixth immunoglobulin heavy chain variable region; Fc is a region comprising an immunoglobulin heavy chain constant region 2 (CH2), an immunoglobulin heavy chain constant region 3 (CH3), and optionally, an immunoglobulin hinge; CH1 is a heavy chain constant region 1; CL is a light chain constant region; and L1, L2, L3, L4, L5, L6, L7, L8, L9, L10 and L11 are amino acid linkers. In some aspects, the first polypeptide has a structure represented by VL1-VL2-VL3-VH3-VH2-VH1, and the second polypeptide has a structure represented by Fc; wherein the first polypeptide comprises a CH1-Fc, CL-Fc, CH1-CL-Fc, or CL-CH1-Fc at its carboxy terminus; optionally wherein VL1, VL2, VL3, VH1, VH2, and VH3 of the first polypeptide are linked to each other via one or more amino acid linker. In some aspects, the first polypeptide has a structure represented by VH1-VH2-VH3-VL3-VL2-VL1, and the second polypeptide has a structure represented by Fc; wherein the first polypeptide comprises a CH1-Fc, CL-Fc, CH1-CL-Fc, or CL-CH1-Fc at its carboxy terminus; optionally wherein VL1, VL2, VL3, VH1, VH2, and VH3 of the first polypeptide are linked to each other via one or more amino acid linker. In some aspects, the first polypeptide has a structure represented by VL1-VH2-VL3-VH3-VL2-VH1, and the second polypeptide has a structure represented by Fc; wherein the first polypeptide comprises a CH1-Fc, CL-Fc, CH1-CL-Fc, or CL-CH1-Fc at its carboxy terminus; optionally wherein VL1, VL2, VL3, VH1, VH2, and VH3 of the first polypeptide are linked to each other via one or more amino acid linker. In some aspects, the first polypeptide has a structure represented by VH1-VL2-VH3-VL3-VH2-VL1, and the second polypeptide has a structure represented by Fc; wherein the first polypeptide comprises a CH1-Fc, CL-Fc, CH1-CL-Fc, or CL-CH1-Fc at its carboxy terminus; optionally wherein VL1, VL2, VL3, VH1, VH2, and VH3 of the first polypeptide are linked to each other via one or more amino acid linker. In some aspects, the first polypeptide has a structure represented by VL1-VL2-VH3-VL3-VH2-VH1, and the second polypeptide has a structure represented by Fc; wherein the first polypeptide comprises a CH1-Fc, CL-Fc, CH1-CL-Fc, or CL-CH1-Fc at its carboxy terminus; optionally wherein VL1, VL2, VL3, VH1, VH2, and VH3 of the first polypeptide are linked to each other via one or more amino acid linker. In some aspects, the first polypeptide has a structure represented by VH1-VH2-VL3-VH3-VL2-VL1, and the second polypeptide has a structure represented by Fc; wherein the first polypeptide comprises a CH1-Fc, CL-Fc, CH1-CL-Fc, or CL-CH1-Fc at its carboxy terminus; optionally wherein VL1, VL2, VL3, VH1, VH2, and VH3 of the first polypeptide are linked to each other via one or more amino acid linker. In some aspects, the first polypeptide has a structure represented by VL1-VH2-VH3-VL3-VL2-VH1, and the second polypeptide has a structure represented by Fc; wherein the first polypeptide comprises a CH1-Fc, CL-Fc, CH1-CL-Fc, or CL-CH1-Fc at its carboxy terminus; optionally wherein VL1, VL2, VL3, VH1, VH2, and VH3 of the first polypeptide are linked to each other via one or more amino acid linker. In some aspects, the first polypeptide has a structure represented by VH1-VL2-VL3-VH3-VH2-VL1, and the second polypeptide has a structure represented by Fc; wherein the first polypeptide comprises a CH1-Fc, CL-Fc, CH1-CL-Fc, or CL-CH1-Fc at its carboxy terminus; optionally wherein VL1, VL2, VL3, VH1, VH2, and VH3 of the first polypeptide are linked to each other via one or more amino acid linker. In some aspects, the first polypeptide has a structure represented by VL1-VL2-VL3-VH3-VH2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; optionally wherein the VL1, VL2, VL3, VH1, VH2, and VH3 of the first polypeptide are linked to each other via one or more amino acid linker and/or wherein the VL4, VL5, VL6, VH4, VH5, and VH6 of the second polypeptide when present are linked to each other via one or more amino acid linker. In some aspects, the first polypeptide has a structure represented by VL1-VL2-VL3-VH3-VH2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker and/or wherein the VL4, VL5, VL6, VH4, VH5, and VH6 of the second polypeptide when present are linked to each other via one or more amino acid linker; wherein the CH1-Fc, CL-Fc, CH1-CL-Fc, or CL-CH1-Fc when present in the second polypeptide is linked to the carboxy terminus of the second polypeptide via one or more amino acid linker. In some aspects, the first polypeptide has a structure represented by VL1-VL2-VL3-VH3-VH2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker. In some aspects, the first polypeptide has a structure represented by VL1-VL2-VL3-VH3-VH2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy terminus of the second polypeptide via one or more amino acid linker. In some aspects, the first polypeptide has a structure represented by VL1-VL2-VL3-VH3-VH2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker and wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy terminus of the second polypeptide via one or more amino acid linker. In some aspects, the first polypeptide has a structure represented by VH1-VH2-VH3-VL3-VL2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; optionally wherein the VL1, VL2, VL3, VH1, VH2, and VH3 of the first polypeptide are linked to each other via one or more amino acid linker and/or wherein the VL4, VL5, VL6, VH4, VH5, and VH6 of the second polypeptide when present are linked to each other via one or more amino acid linker. In some aspects, the first polypeptide has a structure represented by VH1-VH2-VH3-VL3-VL2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker and/or wherein the VL4, VL5, VL6, VH4, VH5, and VH6 of the second polypeptide when present are linked to each other via one or more amino acid linker; wherein the CH1-Fc, CL-Fc, CH1-CL-Fc, or CL-CH1-Fc when present in the second polypeptide is linked to the carboxy terminus of the second polypeptide via one or more amino acid linker. In some aspects, the first polypeptide has a structure represented VH1-VH2-VH3-VL3-VL2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker. In some aspects, the first polypeptide has a structure represented by VH1-VH2-VH3-VL3-VL2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VL5-VH6-VL6-VH5-VL4, VL4-VL5-VH6-VL6-VH5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy terminus of the second polypeptide via one or more amino acid linker. In some aspects, the first polypeptide has a structure represented by VH1-VH2-VH3-VL3-VL2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker and wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy terminus of the second polypeptide via one or more amino acid linker. In some aspects, the first polypeptide has a structure represented by VL1-VH2-VL3-VH3-VL2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; optionally wherein the VL1, VL2, VL3, VH1, VH2, and VH3 of the first polypeptide are linked to each other via one or more amino acid linker and/or wherein the VL4, VL5, VL6, VH4, VH5, and VH6 of the second polypeptide when present are linked to each other via one or more amino acid linker. In some aspects, the first polypeptide has a structure represented by VL1-VH2-VL3-VH3-VL2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker and/or wherein the VL4, VL5, VL6, VH4, VH5, and VH6 of the second polypeptide when present are linked to each other via one or more amino acid linker; wherein the CH1-Fc, CL-Fc, CH1-CL-Fc, or CL-CH1-Fc when present in the second polypeptide is linked to the carboxy terminus of the second polypeptide via one or more amino acid linker. In some aspects, the first polypeptide has a structure represented VL1-VH2-VL3-VH3-VL2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker. In some aspects, the first polypeptide has a structure represented by VL1-VH2-VL3-VH3-VL2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy terminus of the second polypeptide via one or more amino acid linker. In some aspects, the first polypeptide has a structure represented by VL1-VH2-VL3-VH3-VL2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker and wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy terminus of the second polypeptide via one or more amino acid linker. In some aspects, the first polypeptide has a structure represented by VH1-VL2-VH3-VL3-VH2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; optionally wherein the VL1, VL2, VL3, VH1, VH2, and VH3 of the first polypeptide are linked to each other via one or more amino acid linker and/or wherein the VL4, VL5, VL6, VH4, VH5, and VH6 of the second polypeptide when present are linked to each other via one or more amino acid linker. In some aspects, the first polypeptide has a structure represented by VH1-VL2-VH3-VL3-VH2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker and/or wherein the VL4, VL5, VL6, VH4, VH5, and VH6 of the second polypeptide when present are linked to each other via one or more amino acid linker; wherein the CH1-Fc, CL-Fc, CH1-CL-Fc, or CL-CH1-Fc when present in the second polypeptide is linked to the carboxy terminus of the second polypeptide via one or more amino acid linker. In some aspects, the first polypeptide has a structure represented VH1-VL2-VH3-VL3-VH2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker. In some aspects, the first polypeptide has a structure represented by VH1-VL2-VH3-VL3-VH2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy terminus of the second polypeptide via one or more amino acid linker. In some aspects, the first polypeptide has a structure represented by VH1-VL2-VH3-VL3-VH2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker and wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy terminus of the second polypeptide via one or more amino acid linker. In some aspects, the first polypeptide has a structure represented by VL1-VL2-VH3-VL3-VH2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; optionally wherein the VL1, VL2, VL3, VH1, VH2, and VH3 of the first polypeptide are linked to each other via one or more amino acid linker and/or wherein the VL4, VL5, VL6, VH4, VH5, and VH6 of the second polypeptide when present are linked to each other via one or more amino acid linker. In some aspects, the first polypeptide has a structure represented by VL1-VL2-VH3-VL3-VH2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VL4-VL5-VH6-VL6-VH5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker; wherein the CH1-Fc, CL-Fc, CH1-CL-Fc, or CL-CH1-Fc when present in the second polypeptide is linked to the carboxy terminus of the second polypeptide via one or more amino acid linker. In some aspects, the first polypeptide has a structure represented VL1-VL2-VH3-VL3-VH2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VH4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini;

wherein the VL1, VL2, VL3, VH1, VH2, and VH3 of the first polypeptide are linked to each other via one or more amino acid linker. In some aspects, the first polypeptide has a structure represented by VL1-VL2-VH3-VL3-VH2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy terminus of the second polypeptide via one or more amino acid linker. In some aspects, the first polypeptide has a structure represented by VL1-VL2-VH3-VL3-VH2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker and wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy terminus of the second polypeptide via one or more amino acid linker. In some aspects, the first polypeptide has a structure represented by VH1-VH2-VL3-VH3-VL2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; optionally wherein the VL1, VL2, VL3, VH1, VH2, and VH3 of the first polypeptide are linked to each other via one or more amino acid linker and/or wherein the VL4, VL5, VL6, VH4, VH5, and VH6 of the second polypeptide when present are linked to each other via one or more amino acid linker. In some aspects, the first polypeptide has a structure represented by VH1-VH2-VL3-VH3-VL2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VH6-VL6-VH5-VL4; wherein the first polypeptide and second poly-peptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker and/or wherein the VL4, VL5, VL6, VH4, VH5, and VH6 of the second polypeptide when present are linked to each other via one or more amino acid linker; wherein the CH1-Fc, CL-Fc, CH1-CL-Fc, or CL-CH1-Fc when present in the second polypeptide is linked to the carboxy terminus of the second polypeptide via one or more amino acid linker. In some aspects, the first polypeptide has a structure represented VH1-VH2-VL3-VH3-VL2-VL1, and the second polypep-tide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypep-tide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker. In some aspects, the first polypeptide has a structure represented by VH1-VH2-VL3-VH3-VL2-VL1, and the second polypeptide has a structure represented by VL4-VH4, VH4-VL4, VL4-VL5-VH5-VH4, VH4-VH5-VH6-VL6-VL5-VL4, VH4-VH5-VH6-VL6-VL5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy terminus of the second polypeptide via one or more amino acid linker. In some aspects, the first polypeptide has a structure repre-sented by VH1-VH2-VL3-VH3-VL2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker and wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy ter-minus of the second polypeptide via one or more amino acid linker. In some aspects, the first polypeptide has a structure represented by VL1-VH2-VH3-VL3-VL2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VL4-VL5-VH6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; optionally wherein the VL1, VL2, VL3, VH1, VH2, and VH3 of the first polypeptide are linked to each other via one or more amino acid linker and/or wherein the VL4, VL5, VL6, VH4, VH5, and VH6 of the second polypeptide when present are linked to each other via one or more amino acid linker. In some aspects, the first polypeptide has a structure represented by VL1-VH2-VH3-VL3-VL2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker and/or wherein the VL4, VL5, VL6, VH4, VH5, and VH6 of the second polypeptide when present are linked to each other via one or more amino acid linker; wherein the CH1-Fc, CL-Fc, CH1-CL-Fc, or CL-CH1-Fc when present in the second polypeptide is linked to the carboxy terminus of the second polypeptide via one or more amino acid linker. In some aspects, the first polypeptide has a structure represented VL1-VH2-VH3-VL3-VL2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker. In some aspects, the first polypeptide has a structure represented by VL1-VH2-VH3-VL3-VL2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy terminus of the second polypeptide via one or more amino acid linker. In some aspects, the first polypeptide has a structure represented by VL1-VH2-VH3-VL3-VL2-VH1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker and wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy terminus of the second polypeptide via one or more amino acid linker. In some aspects, the first polypeptide has a structure represented by VH1-VL2-VL3-VH3-VH2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; optionally wherein the VL1, VL2, VL3, VH1, VH2, and VH3 of the first polypeptide are linked to each other via one or more amino acid linker and/or wherein the VL4, VL5, VL6, VH4, VH5, and VH6 of the second polypeptide when present are linked to each other via one or more amino acid linker. In some aspects, the first polypeptide has a structure represented by VH1-VL2-VL3-VH3-VH2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker and/or wherein the VL4, VL5, VL6, VH4, VH5, and VH6 of the second polypeptide when present are linked to each other via one or more amino acid linker; wherein the CH1-Fc, CL-Fc, CH1-CL-Fc, or CL-CH1-Fc when present in the second polypeptide is linked to the carboxy terminus of the second polypeptide via one or more amino acid linker. In some aspects, the first polypeptide has a structure represented VH1-VL2-VL3-VH3-VH2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VL4, VL4-VL5-VH6-VL6-VH5-VL4, VL4-VH5-VL6-VH6-VL5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker. In some aspects, the first polypeptide has a structure represented by VH1-VL2-VL3-VH3-VH2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VH4-VL5-VH6-VL6-VH5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy terminus of the second polypeptide via one or more amino acid linker. In some aspects, the first polypeptide has a structure represented by VH1-VL2-VL3-VH3-VH2-VL1, and the second polypeptide has a structure represented by VL4-VH4, VH4-VL4, VL4-VL5-VH5-VH4, VH4-VH5-VL5-VL4, VL4-VL5-VL6-VH6-VH5-VH4, VH4-VH5-VH6-VL6-VL5-VL4, VL4-VH5-VL6-VH6-VL5-VH4, VH4-VL5-VH6-VL6-VH5-VL4, VL4-VL5-VH6-VL6-VH5-VH4, VH4-VH5-VL6-VH6-VL5-VL4, VL4-VH5-VH6-VL6-VL5-VH4 or VH4-VL5-VL6-VH6-VH5-VL4; wherein the first polypeptide and second polypeptide each comprise a CH1-Fc, CL-Fc, CH1-CL-Fc, or CL-CH1-Fc at their carboxy termini; wherein the VL1, VL2, VL3, VH1, VH2, and VH3 of the first polypeptide are linked to each other via one or more amino acid linker and wherein the VL4, VL5, VL6, VH4, VH5, and VH6 of the second polypeptide when present are linked to each other via one or more amino acid linker; optionally wherein the CH1-Fc, CL-Fc, CH1-CL-Fc, or CL-CH1-Fc when present is linked to the carboxy terminus of the second polypeptide via one or more amino acid linker.

In some aspects, the invention is directed to an antigen binding polypeptide comprising at least two CH3 regions or an antigen binding polypeptide complex comprising a polypeptide comprising at least two CH3 regions. For example, the antigen binding polypeptide or antigen binding polypeptide complex may comprise a polypeptide having a structure represented by VL1-VL2-VL3-VH3-VH2-VH1-CH3-CH3; VH1-VH2-VH3-VL3-VL2-VL1-CH3-CH3; VL1-VH2-VL3-VH3-VL2-VH1-CH3-CH3; VH1-VL2-VH3-VL3-VH2-VL1-CH3-CH3; VL1-VL2-VH3-VL3-VH2-VH1-CH3-CH3; VH1-VH2-VL3-VH3-VL2-VL1-CH3-CH3; VL1-VH2-VH3-VL3-VL2-VH1-CH3-CH3; VH1-VL2-VL3-VH3-VH2-VL1-CH3-CH3; VL1-L1-VL2-L2-VL3-L3-VH3-L4-VH2-L5-VH1-CH3-CH3; VH1-L1-VH2-L2-VH3-L3-VL3-L4-VL2-L5-VL1-CH3-CH3; VL1-L1-VH2-L2-VL3-L3-VH3-L4-VL2-L5-VH1-CH3-CH3; VH1-L1-VL2-L2-VH3-L3-VL3-L4-VH2-L5-VL1-CH3-CH3; VL1-L1-VL2-L2-VH3-L3-VL3-L4-VH2-L5-VH1-CH3-CH3; VH1-L1-VH2-L2-VL3-L3-VH3-L4-VL2-L5-VL1-CH3-CH3; VL1-L1-VH2-L2-VH3-L3-VL3-L4-VL2-L5-VH1-CH3-CH3; VH1-L1-VL2-L2-VL3-L3-VH3-L4-VH2-L5-VL1-CH3-CH3; VL1-L1-VL2-L2-VL3-L3-VH3-L4-VH2-L5-VH1-L6-CH3-CH3; VH1-L1-VH2-L2-VH3-L3-VL3-L4-VL2-L5-VL1-L6-CH3-CH3; VL1-L1-VH2-L2-VL3-L3-VH3-L4-VL2-L5-VH1-L6-CH3-CH3; VH1-L1-VL2-L2-VH3-L3-VL3-L4-VH2-L5-VL1-L6-CH3-CH3; VL1-L1-VL2-L2-VH3-L3-VL3-L4-VH2-L5-VH1-L6-CH3-CH3; VH1-L1-VH2-L2-VL3-L3-VH3-L4-VL2-L5-VL1-L6-CH3-CH3; VL1-L1-VH2-L2-VH3-L3-VL3-L4-VL2-L5-VH1-L6-CH3-CH3; VH1-L1-VL2-L2-VL3-L3-VH3-L4-VH2-L5-VL1-L6-CH3-CH3; VL1-L1-VL2-L2-VL3-L3-VH3-L4-VH2-L5-VH1-L6-CH3-L7-CH3; VH1-L1-VH2-L2-VH3-L3-VL3-L4-VL2-L5-VL1-L6-CH3-L7-CH3; VL1-L1-VH2-L2-VL3-L3-VH3-L4-VL2-L5-VH1-L6-CH3-L7-CH3; VH1-L1-VL2-L2-VH3-L3-VL3-L4-VH2-L5-VL1-L6-CH3-L7-CH3; VL1-L1-VL2-L2-VH3-L3-VL3-L4-VH2-L5-VH1-L6-CH3-L7-CH3; VH1-L1-VH2-L2-VL3-L3-VH3-L4-VL2-L5-VL1-L6-CH3-L7-CH3; VL1-L1-VH2-L2-VH3-L3-VL3-L4-VL2-L5-VH1-L6-CH3-L7-CH3; or VH1-L1-VL2-L2-VL3-L3-VH3-L4-VH2-L5-VL1-L6-CH3-L7-CH3; wherein VL1 is a first immunoglobulin light chain variable region; VL2 is a second immunoglobulin light chain variable region; VL3 is a third immunoglobulin light chain variable region; VH1 is a first immunoglobulin heavy chain variable region; VH2 is a second immunoglobulin heavy chain variable region; VH3 is a third immunoglobulin heavy chain variable region; CH3 is an immunoglobulin heavy chain constant region 3; and L1, L2, L3, L4, L5, L6 and L7 are amino acid linkers.

In some aspects, an antigen binding polypeptide complex of the invention comprises first polypeptide, a second polypeptide, and a third polypeptide; wherein the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; wherein the second polypeptide has a structure represented by VL4-VL5; VL4-L6-VL5; VL4-VL5-VL6; or VL4-L6-VL5-L7-VL6; wherein the third polypeptide has a structure represented by VH4-VH5; VH4-L8-VH5; VH4-VH5-VH6; or VH4-L8-VH5-L9-VH6; wherein VL1 is a first immunoglobulin light chain variable region; VL2 is a second immunoglobulin light chain variable region; VL3 is a third immunoglobulin light chain variable region; VL4 is a fourth immunoglobulin light chain variable region; VL5 is a fifth immunoglobulin light chain variable region; VL6 is a sixth immunoglobulin light chain variable region; VH1 is a first immunoglobulin heavy chain variable region; VH2 is a second immunoglobulin heavy chain variable region; VH3 is a third immunoglobulin heavy chain variable region; VH4 is a fourth immunoglobulin heavy chain variable region; VH5 is a fifth immunoglobulin heavy chain variable region; VH6 is a sixth immunoglobulin heavy chain variable region; and L1, L2, L3, L4, L5, L6, L7, L8 and L9 are amino acid linkers. In some aspects, the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-VL5; and the third polypeptide has the structure represented by VH4-VH5. In some aspects, the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-

VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-VL5; and the third polypeptide has the structure represented by VH4-L8-VH5. In some aspects, the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-VL5; and the third polypeptide has the structure represented by VH4-VH5-VH6. In some aspects, the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-VL5; and the third polypeptide has the structure represented by VH4-L8-VH5-L9-VH6. In some aspects, the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-L6-VL5; and the third polypeptide has the structure represented by VH4-VH5. In some aspects, the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-L6-VL5; and the third polypeptide has the structure represented by VH4-L8-VH5. In some aspects, the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-L6-VL5; and the third polypeptide has the structure represented by VH4-VH5-VH6. In some aspects, the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-L6-VL5; and the third polypeptide has the structure represented by VH4-L8-VH5-L9-VH6. In some aspects, the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-VL5-VL6; and the third polypeptide has the structure represented by VH4-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-VL5-VL6; and the third polypeptide has the structure represented by VH4-L8-VH5. In some aspects, the first polypeptide has a structure represented by VL1-VL2-VL3-VH3-VH2-VH1; VH1-VH2-

VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-VL5-VL6; and the third polypeptide has the structure represented by VH4-VH5-VH6. In some aspects, the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-VL5-VL6; and the third polypeptide has the structure represented by VH4-L8-VH5-L9-VH6. In some aspects, the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-L6-VL5-L7-VL6; and the third polypeptide has the structure represented by VH4-VH5. In some aspects, the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-L6-VL5-L7-VL6; and the third polypeptide has the structure represented by VH4-L8-VH5. In some aspects, the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-

VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-L6-VL5-L7-VL6; and the third polypeptide has the structure represented by VH4-VH5-VH6. In some aspects, the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide has the structure represented by VL4-L6-VL5-L7-VL6; and the third polypeptide has the structure represented by VH4-L8-VH5-L9-VH6.

In some aspects, an antigen binding polypeptide complex of the invention comprises a first polypeptide, a second polypeptide, and a third polypeptide; wherein the first polypeptide has a structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; VH1-VL2-VL3-VH3-VH2-VL1-Fc; VL1-L1-VL2-L2-VL3-L3-VH3-L4-VH2-L5-VH1-Fc; VL1-L1-VL2-L2-VL3-L3-VH3-L4-VH2-L5-VH1-L6-Fc; VH1-L1-VH2-L2-VH3-L3-VL3-L4-VL2-L5-VL1-Fc; VH1-L1-VH2-L2-VH3-L3-VL3-L4-VL2-L5-VL1-L6-Fc; VL1-L1-VH2-L2-VL3-L3-VH3-L4-VL2-L5-VH1-Fc; VL1-L1-VH2-L2-VL3-L3-VH3-L4-VL2-L5-VH1-L6-Fc; VH1-L1-VL2-L2-VH3-L3-VL3-L4-VH2-L5-VL1-Fc; VH1-L1-VL2-L2-VH3-L3-VL3-L4-VH2-L5-VL1-L6-Fc; VL1-L1-VL2-L2-VH3-L3-VL3-L4-VH2-L5-VH1-Fc; VL1-L1-VL2-L2-VH3-L3-VL3-L4-VH2-L5-VH1-L6-Fc; VH1-L1-VH2-L2-VL3-L3-VH3-L4-VL2-L5-VL1-Fc; VH1-L1-VH2-L2-VL3-L3-VH3-L4-VL2-L5-VL1-L6-Fc; VL1-L1-VH2-L2-VH3-L3-VL3-L4-VL2-L5-VH1-Fc; VL1-L1-VH2-L2-VH3-L3-VL3-L4-VL2-L5-VH1-L6-Fc; VH1-L1-VL2-L2-VL3-L3-VH3-L4-VH2-L5-VL1-Fc; or VH1-L1-VL2-L2-VL3-L3-VH3-L4-VH2-L5-VL1-L6-Fc; wherein the second polypeptide has a structure represented by VL4-VL5; VL4-L7-VL5; VL4-CL; VL4-L7-CL; VL4-CH1; VL4-L7-CH1; VH4-VH5; VH4-L7-VH5; VH4-CL; VH4-L7-CL; VH4-CH1; VH4-L7-CH1; VL4-VL5-VL6; VL4-L7-VL5-L8-VL6; VL4-VL5-VL6-CL; VL4-L7-VL5-L8-VL6-CL; VL4-L7-VL5-L8-VL6-L9-CL; VL4-VL5-VL6-CH1; VL4-L7-VL5-L8-VL6-CH1; VL4-L7-VL5-L8-VL6-L9-CH1; VH4-VH5-VH6; VH4-L7-VH5-L8-VH6; VH4-VH5-VH6-CL; VH4-L7-VH5-L8-VH6-CL; VH4-L7-VH5-L8-VH6-L9-CL; VH4-VH5-VH6-CH1; VH4-L7-VH5-L8-VH6-CH1; or VH4-L7-VH5-L8-VH6-L9-CH1; wherein the third polypeptide has a structure represented by VH4-VH5-Fc; VH4-L10-VH5-Fc; VH4-L10-VH5-L11-Fc; VH4-CH1-Fc; VH4-L10-CH1-Fc; VH4-L10-CH1-L11-Fc; VH4-CL-Fc; VH4-L10-CL-Fc; VH4-L10-CL-L11-Fc; VH4-VH5-Fc; VH4-

L10-VH5-Fc; VH4-L10-VH5-L11-Fc; VH4-VH5-VH6-Fc; VH4-L10-VH5-L11-VH6-Fc; VH4-L10-VH5-L11-VH6-L12-Fc; VH4-VH5-VH6-CH1-Fc; VH4-L10-VH5-L11-VH6-CH1-Fc; VH4-L10-VH5-L11-VH6-L12-CH1-Fc; VH4-L10-VH5-L11-VH6-L12-CH1-L13-Fc; VH4-VH5-VH6-CL-Fc; VH4-L10-VH5-L11-VH6-CL-Fc; VH4-L10-VH5-L11-VH6-L12-CL-Fc; VH4-L10-VH5-L11-VH6-L12-CL-L13-Fc; VL4-VL5-VL6-Fc; VL4-L10-VL5-L11-VL6-Fc; VL4-L10-VL5-L11-VL6-L12-Fc; VL4-VL5-VL6-CH1-Fc; VL4-L10-VL5-L11-VL6-CH1-Fc VL4-L10-VL5-L11-VL6-L12-CH1-Fc; VL4-L10-VL5-L11-VL6-L12-CH1-L13-Fc; VL4-VL5-VL6-CL-Fc; VL4-L10-VL5-L11-VL6-CL-Fc; VL4-L10-VL5-L11-VL6-L12-CL-Fc; or VL4-L10-VL5-L11-VL6-L12-CL-L13-Fc; wherein VL1 is a first immunoglobulin light chain variable region; VL2 is a second immunoglobulin light chain variable region; VL3 is a third immunoglobulin light chain variable region; VL4 is a fourth immunoglobulin light chain variable region; VL5 is a fifth immunoglobulin light chain variable region; VL6 is a sixth immunoglobulin light chain variable region; VH1 is a first immunoglobulin heavy chain variable region; VH2 is a second immunoglobulin heavy chain variable region; VH3 is a third immunoglobulin heavy chain variable region; VH4 is a fourth immunoglobulin heavy chain variable region; VH5 is a fifth immunoglobulin heavy chain variable region; VH6 is a sixth immunoglobulin heavy chain variable region; Fc is a region comprising an immunoglobulin heavy chain constant region 2 (CH2), an immunoglobulin heavy chain constant region 3 (CH3), and optionally, an immunoglobulin hinge; CH1 is a heavy chain constant region 1; CL is a light chain constant region; and L1, L2, L3, L4, L5, L6, L7, L8, L9, L10, L11, L12 and L13 are amino acid linkers. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4; and the third polypeptide has the structure represented by VH4; wherein the second polypeptide comprises a CL or CH1 at its carboxy terminus, optionally wherein the CL or CH1 is linked to the carboxy terminus of the second polypeptide via one or more amino acid linker; and wherein the third polypeptide comprises a CH1-Fc or CL-Fc at its carboxy terminus; optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4; and the third polypeptide has the structure represented by VH4; wherein the second polypeptide comprises a CL or CH1 at its carboxy terminus, optionally wherein the CL or CH1 is linked to the carboxy terminus of the second polypeptide via one or more amino acid linker; and wherein the third polypeptide comprises a CH1-Fc or CL-Fc at its carboxy terminus; optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4; and the third polypeptide has the structure represented by VH4; wherein the second polypeptide comprises a CL or CH1 at its carboxy terminus, optionally wherein the CL or CH1 is linked to the carboxy terminus of the second polypeptide via one or more amino acid linker; and wherein the third polypeptide comprises a CH1-Fc or CL-Fc at its carboxy terminus; optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4; and the third polypeptide has the structure represented by VH4; wherein the second polypeptide comprises a CL or CH1 at its carboxy terminus, optionally wherein the CL or CH1 is linked to the carboxy terminus of the second polypeptide via one or more amino acid linker; and wherein the third polypeptide comprises a CH1-Fc or CL-Fc at its carboxy terminus; optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5; optionally wherein the VL4 and VL5 of the second polypeptide are linked to each other via one or more amino acid linker; and the third polypeptide has the structure represented by VH4; wherein the third polypeptide comprises a CH1-Fc or CL-Fc at its carboxy terminus; optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-

VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5, optionally wherein the VL4 and VL5 of the second polypeptide are linked to each other via one or more amino acid linker; and the third polypeptide has the structure represented by VH4; wherein the third polypeptide comprises a CH1-Fc or CL-Fc at its carboxy terminus optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5; optionally wherein the VH4 and VH5 of the second polypeptide are linked to each other via one or more amino acid linker; and the third polypeptide has the structure represented by VH4; wherein the third polypeptide comprises a CH1-Fc or CL-Fc at its carboxy terminus; optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5, optionally wherein the VH4 and VH5 of the second polypeptide are linked to each other via one or more amino acid linker; and the third polypeptide has the structure represented by VH4; wherein the third polypeptide comprises a CH1-Fc or CL-Fc at its carboxy terminus optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6; optionally wherein the VL4, VL5 and VL6 of the second polypeptide are linked to each other via one or more amino acid linker; and the third polypeptide has the structure represented by VH4; wherein the third polypeptide comprises a CH1-Fc or CL-Fc at its carboxy terminus; optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6, optionally wherein the VL4, VL5 and VL6 of the second polypeptide are linked to each other via one or more amino acid linker; and the third polypeptide has the structure represented by VH4; wherein the third polypeptide comprises a CH1-Fc or CL-Fc at its carboxy terminus optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CL; optionally wherein the VL4, VL5, VL6 and CL of the second polypeptide are linked to each other via one or more amino acid linker; and the third polypeptide has the structure represented by VH4; wherein the third polypeptide comprises a CH1-Fc or CL-Fc at its carboxy terminus; optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CL, optionally wherein the VL4, VL5, VL6 and CL of the second polypeptide are linked to each other via one or more amino acid linker; and the third polypeptide has the structure represented by VH4; wherein the third polypeptide comprises a CH1-Fc or CL-Fc at its carboxy terminus optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-

VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CL; optionally wherein the VL4, VL5 and VL6 of the second polypeptide are linked to each other via one or more amino acid linker; and the third polypeptide has the structure represented by VH4; wherein the third polypeptide comprises a CH1-Fc or CL-Fc at its carboxy terminus; optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CL, optionally wherein the VL4, VL5 and VL6 of the second polypeptide are linked to each other via one or more amino acid linker; and the third polypeptide has the structure represented by VH4; wherein the third polypeptide comprises a CH1-Fc or CL-Fc at its carboxy terminus optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CH1; optionally wherein the VL4, VL5 and VL6 of the second polypeptide are linked to each other via one or more amino acid linker; and the third polypeptide has the structure represented by VH4; wherein the third polypeptide comprises a CH1-Fc or CL-Fc at its carboxy terminus; optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CH1, optionally wherein the VL4, VL5 and VL6 of the second polypeptide are linked to each other via one or more amino acid linker; and the third polypeptide has the structure represented by VH4; wherein the third polypeptide comprises a CH1-Fc or CL-Fc at its carboxy terminus optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CH1; optionally wherein the VL4, VL5, VL6 and CH1 of the second polypeptide are linked to each other via one or more amino acid linker; and the third polypeptide has the structure represented by VH4; wherein the third polypeptide comprises a CH1-Fc or CL-Fc at its carboxy terminus; optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CH1, optionally wherein the VL4, VL5, VL6 and CH1 of the second polypeptide are linked to each other via one or more amino acid linker; and the third polypeptide has the structure represented by VH4; wherein the third polypeptide comprises a CH1-Fc or CL-Fc at its carboxy terminus optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6; optionally wherein the VH4, VH5 and VH6 of the second polypeptide are linked to each other via one or more amino acid linker; and the third polypeptide has the structure represented by VH4; wherein the third polypeptide comprises a CH1-Fc or CL-Fc at its carboxy terminus; optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6, optionally wherein the VH4, VH5 and VH6 of the second polypeptide are linked to each other via one or more amino acid linker; and the third polypeptide has the structure represented by VH4; wherein the third polypeptide comprises a CH1-Fc or CL-Fc at its carboxy terminus optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CL; optionally wherein the VH4, VH5 and VH6 of the second polypeptide are linked to each other via one or more amino acid linker; and the third polypeptide has the structure represented by VH4; wherein the third polypeptide comprises a CH1-Fc or CL-Fc at its carboxy terminus; optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6-CL, optionally wherein the VH4, VH5 and VH6 of the second polypeptide are linked to each other via one or more amino acid linker; and the third polypeptide has the structure represented by VH4; wherein the third polypeptide comprises a CH1-Fc or CL-Fc at its carboxy terminus optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CL; optionally wherein the VH4, VH5, VH6 and CL of the second polypeptide are linked to each other via one or more amino acid linker; and the third polypeptide has the structure represented by VH4; wherein the third polypeptide comprises a CH1-Fc or CL-Fc at its carboxy terminus; optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6-CL, optionally wherein the VH4, VH5, VH6 and CL of the second polypeptide are linked to each other via one or more amino acid linker; and the third polypeptide has the structure represented by VH4; In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CH1, optionally wherein the VH4, VH5 and VH6 of the second polypeptide are linked to each other via one or more amino acid linker; and the third polypeptide has the structure represented by VH4; wherein the third polypeptide comprises a CH1-Fc or CL-Fc at its carboxy terminus optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6-CH1, optionally wherein the VH4, VH5 and VH6 of the second polypeptide are linked to each other via one or more amino acid linker; and the third polypeptide has the structure represented by VH4; wherein the third polypeptide comprises a CH1-Fc or CL-Fc at its carboxy terminus optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CH1; optionally wherein the VH4, VH5, VH6 and CH1 of the second polypeptide are linked to each other via one or more amino acid linker; and the third polypeptide has the structure represented by VH4; wherein the third polypeptide comprises a CH1-Fc or CL-Fc at its carboxy terminus; optionally wherein the CH1-Fc or CL-Fc is linked to the carboxy terminus of the third polypeptide via one or more amino acid linker and optionally wherein the CH1 and Fc or CL and Fc are linked by one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CH1, optionally wherein the VH4, VH5, VH6 and CH1 of the second polypeptide are linked to each other via one or more amino acid linker; and the third polypeptide has the structure represented by VH4; wherein the third polypeptide comprises a CH1-Fc or CL-Fc at its carboxy terminus optionally wherein the CH1-Fc or CL-Fc is linked to the carboxy terminus of the third polypeptide via one or more amino acid linker and optionally wherein the CH1 and Fc or CL and Fc are linked by one or more amino acid linker.

In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4; wherein the second polypeptide comprises a CL or CH1 at its carboxy terminus, optionally wherein the CL or CH1 is linked to the carboxy terminus of the second polypeptide via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4; wherein the second polypeptide comprises a CL or CH1 at its carboxy terminus, optionally wherein the CL or CH1 is linked to the carboxy terminus of the second polypeptide via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4; wherein the second polypeptide comprises a CL or CH1 at its carboxy terminus, optionally wherein the CL or CH1 is linked to the carboxy terminus of the second polypeptide via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4; wherein the second polypeptide comprises a CL or CH1 at its carboxy terminus, optionally wherein the CL or CH1 is linked to the carboxy terminus of the second polypeptide via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5; optionally wherein the VL4 and VL5 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5, optionally wherein the VL4 and VL5 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5; optionally wherein the VH4 and VH5 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5, optionally wherein the VH4 and VH5 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6; optionally wherein the VL4, VL5 and VL6 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VH3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6, optionally wherein the VL4, VL5 and VL6 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CL; optionally wherein the VL4, VL5, VL6 and CL of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CL, optionally wherein the VL4, VL5, VL6 and CL of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CL; optionally wherein the VL4, VL5 and VL6 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CL, optionally wherein the VL4, VL5 and VL6 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CH1; optionally wherein the VL4, VL5 and VL6 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-

VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CH1, optionally wherein the VL4, VL5 and VL6 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CH1; optionally wherein the VL4, VL5, VL6 and CH1 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CH1, optionally wherein the VL4, VL5, VL6 and CH1 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6; optionally wherein the VH4, VH5 and VH6 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-

VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6, optionally wherein the VH4, VH5 and VH6 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CL; optionally wherein the VH4, VH5 and VH6 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6-CL, optionally wherein the VH4, VH5 and VH6 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CL; optionally wherein the VH4, VH5, VH6 and CL of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6-CL, optionally wherein the VH4, VH5, VH6 and CL of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CH1, optionally wherein the VH4, VH5 and VH6 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6-CH1, optionally wherein the VH4, VH5 and VH6 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CH1; optionally wherein the VH4, VH5, VH6 and CH1 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CH1, optionally wherein the VH4, VH5, VH6 and CH1 of the second polypeptide are linked to each other via one or more amino acid linker; and wherein the third polypeptide has the structure represented by VH4-VH5-Fc; optionally wherein the VH4 and VH5 or the VH4, VH5 and Fc are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4; wherein the second polypeptide comprises a CL or CH1 at its carboxy terminus, optionally wherein the CL or CH1 is linked to the carboxy terminus of the second polypeptide via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4; wherein the second polypeptide comprises a CL or CH1 at its carboxy terminus, optionally wherein the CL or CH1 is linked to the carboxy terminus of the second polypeptide via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4; wherein the second polypeptide comprises a CL or CH1 at its carboxy terminus, optionally wherein the CL or CH1 is linked to the carboxy terminus of the second polypeptide via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-

VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4; wherein the second polypeptide comprises a CL or CH1 at its carboxy terminus, optionally wherein the CL or CH1 is linked to the carboxy terminus of the second polypeptide via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5; optionally wherein the VL4 and VL5 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5, optionally wherein the VL4 and VL5 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5; optionally wherein the VH4 and VH5 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5, optionally wherein the VH4 and VH5 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6; optionally wherein the VL4, VL5 and VL6 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6, optionally wherein the VL4, VL5 and VL6 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-

VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CL; optionally wherein the VL4, VL5, VL6 and CL of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CL, optionally wherein the VL4, VL5, VL6 and CL of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CL; optionally wherein the VL4, VL5 and VL6 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CL, optionally wherein the VL4, VL5 and VL6 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CH1; optionally wherein the VL4, VL5 and VL6 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CH1, optionally wherein the VL4, VL5 and VL6 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CH1; optionally wherein the VL4, VL5, VL6 and CH1 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CH1, optionally wherein the VL4, VL5, VL6 and CH1 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6; optionally wherein the VH4, VH5 and VH6 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6, optionally wherein the VH4, VH5 and VH6 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CL; optionally wherein the VH4, VH5 and VH6 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6-CL, optionally wherein the VH4, VH5 and VH6 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CL; optionally wherein the VH4, VH5, VH6 and CL of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6-CL, optionally wherein the VH4, VH5, VH6 and CL of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CH1, optionally wherein the VH4, VH5 and VH6 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6-CH1, optionally wherein the VH4, VH5 and VH6 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CH1; optionally wherein the VH4, VH5, VH6 and CH1 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CH1, optionally wherein the VH4, VH5, VH6 and CH1 of the second polypeptide are linked to each other via one or more amino acid linker; and wherein the third polypeptide has the structure VL4-VL5-VL6-Fc, VL4-VL5-VL6-CH1-Fc or VL4-VL5-VL6-CL-Fc, optionally wherein the VL4, VL5, and VL6 when present are linked to each other via one or more amino acid linker; optionally wherein the VL4, VL5, VL6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VH1-

Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4; wherein the second polypeptide comprises a CL or CH1 at its carboxy terminus, optionally wherein the CL or CH1 is linked to the carboxy terminus of the second polypeptide via one or more amino acid linker; and wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4; wherein the second polypeptide comprises a CL or CH1 at its carboxy terminus, optionally wherein the CL or CH1 is linked to the carboxy terminus of the second polypeptide via one or more amino acid linker; and wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4; wherein the second polypeptide comprises a CL or CH1 at its carboxy terminus, optionally wherein the CL or CH1 is linked to the carboxy terminus of the second polypeptide via one or more amino acid linker; and wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4; wherein the second polypeptide comprises a CL or CH1 at its carboxy terminus, optionally wherein the CL or CH1 is linked to the carboxy terminus of the second polypeptide via one or more amino acid linker; and wherein the third polypeptide has the structure VH4-VH5-vH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5; optionally wherein the VL4 and VL5 of the second polypeptide are linked to each other via one or more amino acid linker; and wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5, optionally wherein the VL4 and VL5 of the second polypeptide are linked to each other via one or more amino acid linker; wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5; optionally wherein the VH4 and VH5 of the second polypeptide are linked to each other via one or more amino acid linker; wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-

VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5, optionally wherein the VH4 and VH5 of the second polypeptide are linked to each other via one or more amino acid linker; wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6; optionally wherein the VL4, VL5 and VL6 of the second polypeptide are linked to each other via one or more amino acid linker; wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6, optionally wherein the VL4, VL5 and VL6 of the second polypeptide are linked to each other via one or more amino acid linker; wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CL; optionally wherein the VL4, VL5, VL6 and CL of the second polypeptide are linked to each other via one or more amino acid linker; wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CL, optionally wherein the VL4, VL5, VL6 and CL of the second polypeptide are linked to each other via one or more amino acid linker; wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CL; optionally wherein the VL4, VL5 and VL6 of the second polypeptide are linked to each other via one or more amino acid linker; and wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VH2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CL, optionally wherein the VL4, VL5 and VL6 of the second polypeptide are linked to each other via one or more amino acid linker; and wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VL2-VH3-VL3-VH2-VH1-Fc; VH1-VH2-VL3-VH3-

VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CH1; optionally wherein the VL4, VL5 and VL6 of the second polypeptide are linked to each other via one or more amino acid linker; and wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CH1, optionally wherein the VL4, VL5 and VL6 of the second polypeptide are linked to each other via one or more amino acid linker; and wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VL4-VL5-VL6-CH1; optionally wherein the VL4, VL5, VL6 and CH1 of the second polypeptide are linked to each other via one or more amino acid linker; wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CH1, optionally wherein the VL4, VL5, VL6 and CH1 of the second polypeptide are linked to each other via one or more amino acid linker; wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6; optionally wherein the VH4, VH5 and VH6 of the second polypeptide are linked to each other via one or more amino acid linker; wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6, optionally wherein the VH4, VH5 and VH6 of the second polypeptide are linked to each other via one or more amino acid linker; wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CL; optionally wherein the VH4, VH5 and VH6 of the second polypeptide are linked to each other via one or more amino acid linker; wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6-CL, optionally wherein the VH4, VH5 and VH6 of the second polypeptide are linked to each other via one or more amino acid linker; and wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CL; optionally wherein the VH4, VH5, VH6 and CL of the second polypeptide are linked to each other via one or more amino acid linker; wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6-CL, optionally wherein the VH4, VH5, VH6 and CL of the second polypeptide are linked to each other via one or more amino acid linker; wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CH1, optionally wherein the VH4, VH5 and VH6 of the second polypeptide are linked to each other via one or more amino acid linker; wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker.

In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VH4-VH5-VH6-CH1, optionally wherein the VH4, VH5 and VH6 of the second polypeptide are linked to each other via one or more amino acid linker; and wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, and VH3 of the first polypeptide are linked to each other via one or more amino acid linker; the second polypeptide has the structure represented by VH4-VH5-VH6-CH1; optionally wherein the VH4, VH5, VH6 and CH1 of the second polypeptide are linked to each other via one or more amino acid linker; and wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. In some aspects, the first polypeptide has the structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; or VH1-VL2-VL3-VH3-VH2-VL1-Fc; optionally wherein the VL1, VL2, VL3, VH1, VH2, VH3 and Fc of the first polypeptide are linked to each other via one or more amino acid linker; the second polypeptide has the structure represented by VL4-VL5-VL6-CH1, optionally wherein the VH4, VH5, VH6 and CH1 of the second polypeptide are linked to each other via one or more amino acid linker; and wherein the third polypeptide has the structure VH4-VH5-VH6-Fc, VH4-VH5-VH6-CH1-Fc or VH4-VH5-VH6-CL-Fc, optionally wherein the VH4, VH5, and VH6 when present are linked to each other via one or more amino acid linker; optionally wherein the VH4, VH5, VH6, CH1, CL and Fc when present are linked to each other via one or more amino acid linker. Any one of the first polypeptides described herein may be combined with any one of the second and/or third polypeptides described herein to form an antigen binding polypeptide complex of the invention.

All the disclosures relating to the antigen binding polypeptide structures described herein and the antigen binding polypeptide complex structures described herein apply to and can be combined with all the VH and VL regions described herein including all the target antigens described herein and all the VH and VL sequences and CDR sequences described herein.

In some aspects, provided herein is an antigen binding polypeptide having a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1;

wherein: VL1 is a first immunoglobulin light chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VL2 is a second immunoglobulin light chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VL3 is a third immunoglobulin light chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VH1 is a first immunoglobulin heavy chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VH2 is a second immunoglobulin heavy chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VH3 is a third immunoglobulin heavy chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; L1, L2, L3, L4 and L5 are amino acid linkers; wherein said antigen binding polypeptide further comprises at least one of the following (i)-(xxi): (i) an Fc region having an optional immunoglobulin hinge, wherein the immunoglobulin hinge comprises an upper hinge region, a middle hinge region, a lower hinge region, or a combination thereof; (ii) a linker selected from the group consisting of L1, L2, L3, L4 or L5 having a length of from about 1 amino acid to about 50 amino acids; (iii) a linker selected from the group consisting of L1, L2, L3, L4 or L5 selected from the group consisting of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 679, SEQ ID NO: 680, SEQ ID NO: 681, SEQ ID NO: 682, SEQ ID NO: 683, SEQ ID NO: 684, SEQ ID NO: 685, and SEQ ID NO: 686, or a sequence having at least 50%, at least 60%, at least 70%, at least 80%, at least 90%, or at least 95% identity to any one of SEQ ID NOs:1-19 and 679-686; (iv) a linker selected from the group consisting of L1, L2, L3, L4 and L5 which is non-immunogenic; (v) a linker selected from the group consisting of L1, L2, L3, L4 and L5 wherein said linker does not contain a consensus T cell epitope; (vi) an Fc region comprising at least one knob-into-hole modification; (vii) a detectable label; (viii) a detectable label selected from the group consisting of a radioactive label, chemiluminescent label, fluorescent label, enzyme, or peptide tag, or a combination thereof; (ix) a peptide tag; (x) a peptide tag selected from a polyhistidine tag consisting of from about 4 to about 10 histidine residues; (xi) a peptide tag having about 8 histidine residues; (xii) the polypeptide is conjugated to an agent to form an antibody-agent conjugate; (xiii) an antibody-agent conjugate wherein the agent is selected from the group consisting of a cytotoxic agent, an immunomodulating agent, an imaging agent, a therapeutic protein, or a combination thereof; (xiv) an antigen binding polypeptide having an equilibrium dissociation constant (KD) of from about 10 μM to about 1 pM when bound to an epitope on a target antigen or when complexed with another antigen binding polypeptide to form an antigen binding polypeptide complex having at least two antigen binding polypeptides; (xv) an antibody or antigen binding fragment thereof; (xvi) an antibody or antigen binding fragment thereof selected from the group consisting of IgG, IgM, IgE, IgA or IgD; (xvii) an antibody or antigen binding fragment thereof selected from an IgG antibody selected from the group consisting of IgG1, IgG2, IgG3 or IgG4; (xviii) an antibody or antigen binding fragment selected from the group consisting of Fab, scFab, Fab', F(ab')2, Fv or scFv; (xix) an antigen binding polypeptide having an effector function mutation; (xx) an antigen bind polypeptide which, when formed into an antigen binding polypeptide complex, is an IgG1 or IgG4 antibody and the knob-into-hole modification comprises: (i) knob substitutions of S354C and T366W and hole substitutions of Y349C, T366S, L368A and Y407V; (ii) hole substitutions of L234A, L235A and P239A; (iii) hole substitutions of L234A and L235A; (iv) hole substitutions of M428L and N433S; (v) hole substitutions of M252Y, S254T and T256E; or (vi) a combination thereof, based on the EU numbering scheme; and (xxi) an antigen binding polypeptide as part of a chimeric receptor antigen. For the avoidance of doubt, all the antigen binding polypeptide structures described herein can be combined with any one or more of the HIV targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VL4, VL5, VL6, VH1, VH2, VH3, VH4, VH5 and/or VH6 of each and every antigen binding polypeptide and antigen binding polypeptide complex described herein may independently bind to any one of said particularly preferred targets.

In some aspects, provided herein is an antigen binding polypeptide complex comprising a first polypeptide and a second polypeptide; wherein the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; wherein the second polypeptide has a structure represented by: Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1 is a first immunoglobulin light chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, 112, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VL2 is a second immunoglobulin light chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VL3 is a third immunoglobu-lin light chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VL4 is a fourth immuno-globulin light chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VL5 is a fifth immunoglobu-lin light chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VL6 is a sixth immunoglobu-lin light chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VH1 is a first immunoglobulin heavy chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VH2 is a second immunoglobulin heavy chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VH3 is a third immunoglobulin heavy chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VH4 is a fourth first immunoglobulin heavy chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VH5 is a fifth immunoglobulin heavy chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VH6 is a sixth immunoglobulin heavy chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, IL1A, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; L1, L2, L3, L4, L5, L6, L7, L8, L9 and L10 are amino acid linkers; wherein said antigen binding polypeptide complex further comprises at least one of the following (i)-(xxi): (i) an Fc region having an optional immunoglobulin hinge, wherein the immunoglobulin hinge comprises an upper hinge region, a middle hinge region, a lower hinge region, or a combination thereof; (ii) a linker selected from the group consisting of L1, L2, L3, L4, L5, L6, L7, L8, L9, or L10 having a length of from about 1 amino acid to about 50 amino acids; (iii) a linker selected from the group consisting of L1, L2, L3, L4, L5, L6, L7, L8, L9, or L10 selected from the group consisting of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 679, SEQ ID NO: 680, SEQ ID NO: 681, SEQ ID NO: 682, SEQ ID NO: 683, SEQ ID NO: 684, SEQ ID NO: 685, and SEQ ID NO: 686, or a sequence having at least 50%, at least 60%, at least 70%, at least 80%, at least 90%, or at least 95% identity to any one of SEQ ID NOs:1-19 and 679-686; (iv) a linker selected from the group consisting of L1, L2, L3, L4, L5, L6, L7, L8, L9, and L10 which is non-immunogenic; (v) a linker selected from the group consisting of L1, L2, L3, L4, L5, L6, L7, L8, L9, and L10 wherein said linker does not contain a consensus T cell epitope; (vi) an Fc region comprising at least one knob-into-hole modification; (vii) a detectable label; (viii) a detectable label selected from the group consisting of a radioactive label, chemiluminescent label, fluorescent label, enzyme, or peptide tag, or a combination thereof; (ix) a peptide tag; (x) a peptide tag selected from a polyhistidine tag consisting of from about 4 to about 10 histidine residues; (xi) a peptide tag having about 8 histidine residues; (xii) the polypeptide is conjugated to an agent to form an antibody-agent conjugate; (xiii) an antibody-agent conjugate wherein the agent is selected from the group consisting of a cytotoxic agent, an immunomodulating agent, an imaging agent, a therapeutic protein, or a combination thereof; (xiv) an antigen binding polypeptide having an equilibrium dissociation constant (KD) of from about 10 μM to about 1 pM when bound to an epitope on a target antigen or when complexed with another antigen binding polypeptide to form an antigen binding polypeptide complex having at least two antigen binding polypeptides; (xv) an antibody or antigen binding fragment thereof; (xvi) an antibody or antigen binding fragment thereof selected from the group consisting of IgG, IgM, IgE, IgA or IgD; (xvii) an antibody or antigen binding fragment thereof selected from an IgG antibody selected from the group consisting of IgG1, IgG2, IgG3 or IgG4; (xviii) an antibody or antigen binding fragment selected from the group consisting of Fab, scFab, Fab', F(ab')$_2$, Fv or scFv; (xix) an antigen binding polypeptide having an effector function mutation; (xx) an antigen bind polypeptide which, when formed into an antigen binding polypeptide complex, is an IgG1 or IgG4 antibody and the knob-into-hole modification comprises: (i) knob substitutions of S354C and T366W and hole substitutions of Y349C, T366S, L368A and Y407V; (ii) hole substitutions of L234A, L235A and P239A; (iii) hole substitutions of L234A and L235A; (iv) hole substitutions of M428L and N433S; (v) hole substitutions of M252Y, S254T and T256E; or (vi) a combination thereof, based on the EU numbering scheme; and (xxi) an antigen binding polypeptide as part of a chimeric receptor antigen. For the avoidance of doubt, all the antigen binding polypeptide structures described herein can be combined with any one or more of the HIV targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VL4, VL5, VL6, VH1, VH2, VH3, VH4, VH5 and/or VH6 of each and every antigen binding polypeptide and antigen binding polypeptide complex described herein may independently bind to any one of said particularly preferred targets.

In some aspects, provided herein is an antigen binding polypeptide complex comprising a first polypeptide, a second polypeptide, and a third polypeptide; wherein the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; wherein the second polypeptide has a structure represented by VL4-

VL5; VL4-L6-VL5; VL4-VL5-VL6; or VL4-L6-VL5-L7-VL6; wherein the third polypeptide has a structure represented by VH4-VH5; VH4-L6-VH5; VH4-VH5-VH6; or VH4-L6-VH5-L7-VH6; wherein VL1 is a first immunoglobulin light chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, 114, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TGFbeta, GP100, GPRC5D, CD30 and CD16A; VL2 is a second immunoglobulin light chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VL3 is a third immunoglobulin light chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VL4 is a fourth immunoglobulin light chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VL5 is a fifth immunoglobulin light chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VL6 is a sixth immunoglobulin light chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VH1 is a first immunoglobulin heavy chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VH2 is a second immunoglobulin heavy chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VH3 is a third immunoglobulin heavy chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VH4 is a fourth first immunoglobulin heavy chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VH5 is a fifth immunoglobulin heavy chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; VH6 is a sixth immunoglobulin heavy chain variable region that specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A; L1, L2, L3, L4, L5, L6 and L7 are amino acid linkers; wherein said antigen binding polypeptide complex further comprises at least one of the following (i)-(xxi): (i) an Fc region having an optional immunoglobulin hinge, wherein the immunoglobulin hinge comprises an upper hinge region, a middle hinge region, a lower hinge region, or a combination thereof; (ii) a linker selected from the group consisting of L1, L2, L3, L4, L5, L6 and L7 having a length of from about 1 amino acid to about 50 amino acids; (iii) a linker selected from the group consisting of L1, L2, L3, L4, L5, L6 and L7 selected from the group consisting of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 679, SEQ ID NO: 680, SEQ ID NO: 681, SEQ ID NO: 682, SEQ ID NO: 683, SEQ ID NO: 684, SEQ ID NO: 685, and SEQ ID NO: 686, or a sequence having at least 50%, at least 60%, at least 70%, at least 80%, at least 90%, or at least 95% identity to any one of SEQ ID NOs:1-19 and 679-686; (iv) a linker selected from the group consisting of L1, L2, L3, L4, L5, L6 and L7 which is non-immunogenic; (v) a linker selected from the group consisting of L1, L2, L3, L4, L5, L6 and L7 wherein said linker does not contain a consensus T cell epitope; (vi) an Fc region comprising at least one knob-into-hole modification; (vii) a detectable label; (viii) a detectable label selected from the group consisting of a radioactive label, chemiluminescent label, fluorescent label, enzyme, or peptide tag, or a combination thereof; (ix) a peptide tag; (x) a peptide tag selected from a polyhistidine tag consisting of from about 4 to about 10 histidine residues; (xi) a peptide tag having about 8 histidine residues; (xii) the polypeptide is conjugated to an agent to form an antibody-agent conjugate; (xiii) an antibody-agent conjugate wherein the agent is selected from the group consisting of a cytotoxic agent, an immunomodulating agent, an imaging agent, a therapeutic protein, or a combination thereof; (xiv) an antigen binding polypeptide having an equilibrium dissociation constant (KD) of from about 10 μM to about 1 pM when bound to an epitope on a target antigen or when complexed with another antigen binding polypeptide to form an antigen binding polypeptide complex having at least two antigen binding polypeptides; (xv) an antibody or antigen binding fragment thereof; (xvi) an antibody or antigen binding fragment thereof selected from the group consisting of IgG, IgM, IgE, IgA or IgD; (xvii) an antibody or antigen binding fragment thereof selected from an IgG antibody selected from the group consisting of IgG1, IgG2, IgG3 or IgG4; (xviii) an antibody or antigen binding fragment selected from the group consisting of Fab, scFab, Fab', F(ab')₂, Fv or scFv; (xix) an antigen binding polypeptide having an effector function mutation; (xx) an antigen bind polypeptide which, when formed into an antigen binding polypeptide complex, is an IgG1 or IgG4 antibody and the knob-into-hole modification comprises: (i) knob substitutions of S354C and T366W and hole substitutions of Y349C, T366S, L368A and Y407V; (ii) hole substitutions of L234A, L235A and P239A; (iii) hole substitutions of L234A and L235A; (iv) hole substitutions of M428L and N433S; (v) hole substitutions of M252Y, S254T and T256E; or (vi) a combination thereof, based on the EU numbering scheme; and (xxi) an antigen binding polypeptide as part of a chimeric receptor antigen. For the avoidance of doubt, all the antigen binding polypeptide structures described herein can be combined with any one or more of the HIV targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VL4, VL5, VL6, VH1, VH2, VH3, VH4, VH5 and/or VH6 of each and every antigen binding polypeptide and antigen binding polypeptide complex described herein may independently bind to any one of said particularly preferred targets.

In some aspects, an antigen binding polypeptide or antigen binding polypeptide complex of the invention does not specifically bind to an antigen associated with human immunodeficiency virus (HIV) (e.g., an HIV envelope protein) and/or an antigen associated with severe acute respiratory syndrome (SARS). In some aspects, the invention is directed to antigen binding polypeptides or antigen binding polypeptide complexes (e.g., antibodies or antigen binding fragments thereof) that specifically bind a viral peptide, protein, polypeptide, or a fragment thereof. In some aspects, the viral peptide, protein, polypeptide, or a fragment thereof is influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus type A/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, or glycoprotein E1E2 of human hepatitis C virus. For example, said viral peptides, proteins, polypeptides or glycosylated versions thereof are selected from the group consisting of: influenza virus neuraminidase, influenza virus hemagglutinin, herpes simplex virus (HSV) viral proteins, core protein, matrix protein or other protein of Dengue virus, and swine influenza viral proteins.

All the antigen binding polypeptide structures described herein and all the antigen binding polypeptide complex structures described herein can specifically bind to one or more of the viral antigen targets described herein, namely one or more of (such as two or more, three or more or four of): influenza virus neuraminidase, influenza virus hemagglutinin, herpes simplex virus (HSV) viral proteins, core protein, matrix protein or other protein of Dengue virus, and swine influenza viral proteins.

In some aspects, the antigen binding polypeptide and the antigen binding polypeptide complex can specifically bind to influenza virus neuraminidase. In some aspects, the antigen binding polypeptide or the antigen binding polypeptide complex comprises a VL1 that specifically binds to influenza virus neuraminidase. In some aspects, the antigen binding polypeptide or the antigen binding polypeptide complex comprises a VL2 that specifically binds to influenza virus neuraminidase. In some aspects, the antigen binding polypeptide or the antigen binding polypeptide complex comprises a VH1 that specifically binds to influenza virus neuraminidase. In some aspects, the antigen binding polypeptide or the antigen binding polypeptide complex comprises a VH2 that specifically binds to influenza virus neuraminidase. In some aspects, the antigen binding polypeptide and the antigen binding polypeptide complex can specifically bind to influenza virus hemagglutinin. In some aspects, the antigen binding polypeptide or the antigen binding polypeptide complex comprises a VL1 that specifically binds to influenza virus hemagglutinin. In some aspects, the antigen binding polypeptide or the antigen binding polypeptide complex comprises a VL2 that specifically binds to influenza virus hemagglutinin. In some aspects, the antigen binding polypeptide or the antigen binding polypeptide complex comprises a VH1 that specifically binds to influenza virus hemagglutinin. In some aspects, the antigen binding polypeptide or the antigen binding polypeptide complex comprises a VH2 that specifically binds to influenza virus hemagglutinin. In some aspects, the antigen binding polypeptide and the antigen binding polypeptide complex can specifically bind to herpes simplex virus (HSV) viral proteins. In some aspects, the antigen binding polypeptide or the antigen binding polypeptide complex comprises a VL1 that specifically binds to herpes simplex virus (HSV) viral proteins. In some aspects, the antigen binding polypeptide or the antigen binding polypeptide complex comprises a VL2 that specifically binds to herpes simplex virus (HSV) viral proteins. In some aspects, the antigen binding polypeptide or the antigen binding polypeptide complex comprises a VH1 that specifically binds to herpes simplex virus (HSV) viral proteins. In some aspects, the antigen binding polypeptide or the antigen binding polypeptide complex comprises a VH2 that specifically binds to herpes simplex virus (HSV) viral proteins. In some aspects, the antigen binding polypeptide and the antigen binding polypeptide complex can specifically bind to gue virus. In some aspects, the antigen binding polypeptide or the antigen binding polypeptide complex comprises a VL1 that specifically binds to Dengue virus. In some aspects, the antigen binding polypeptide or the antigen binding polypeptide complex comprises a VL2 that specifically binds to Dengue virus. In some aspects, the antigen binding polypeptide or the antigen binding polypeptide complex comprises a VH1 that specifically binds to Dengue virus. In some aspects, the antigen binding polypeptide or the antigen binding polypeptide complex comprises a VH2 that specifically binds to Dengue virus. In some aspects, the antigen binding polypeptide and the antigen binding polypeptide complex can specifically bind to swine influenza virus. In some aspects, the antigen binding polypeptide described herein or the antigen binding polypeptide complex described herein comprises a VL1 that specifically binds to swine influenza virus. In some aspects, the antigen binding polypeptide described herein or the antigen binding polypeptide complex described herein comprises a VL2 that specifically binds to swine influenza virus. In some aspects, the antigen binding polypeptide described herein or the antigen binding polypeptide complex described herein comprises a VH1 that specifically binds to swine influenza virus. In some aspects, the antigen binding polypeptide described herein or the antigen binding polypeptide complex described herein comprises a VH2 that specifically binds to swine influenza virus.

In some aspects, the antigen binding polypeptide or antigen binding polypeptide complex specifically binds at least one epitope on at least one viral protein selected from: influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, glycoprotein E1E2 of human hepatitis C virus. In some aspects, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to a viral peptide, protein, polypeptide, or a fragment thereof such as influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, glycoprotein E1E2 of human hepatitis C virus or a combination thereof. For example, the antigen binding polypeptide or polypeptide comprised within the antigen binding complex may comprise a VL1 that specifically binds to influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, glycoprotein E1E2 of human hepatitis C virus or a combination thereof. For example, the antigen binding polypeptide or polypeptide comprised within the antigen binding complex may comprise a VL2 that specifically binds to influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, glycoprotein E1E2 of human hepatitis C virus or a combination thereof For example, the antigen binding polypeptide or polypeptide comprised within the antigen binding complex may comprise a VL3 that specifically binds to influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, glycoprotein E1E2 of human hepatitis C virus or a combination thereof. For example, the antigen binding polypeptide or polypeptide comprised within the antigen binding complex may comprise a VL4 that specifically binds to influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, glycoprotein E1E2 of human hepatitis C virus or a combination thereof. For example, the antigen binding polypeptide or polypeptide comprised within the antigen binding complex may comprise a VL5 that specifically binds to influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, glycoprotein E1E2 of human hepatitis C virus or a combination thereof. For example, the antigen binding polypeptide or polypeptide comprised within the antigen binding complex may comprise a VL6 that specifically binds to influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, glycoprotein E1E2 of human hepatitis C virus or a combination thereof. For example, the antigen binding polypeptide or polypeptide comprised within the antigen binding complex may comprise a VH1 that specifically binds to influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, glycoprotein E1E2 of human hepatitis C virus or a combination thereof. For example, the antigen binding polypeptide or polypeptide comprised within the antigen binding complex may comprise a VH2 that specifically binds to influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Semulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, glycoprotein E1E2 of human hepatitis C virus or a combination thereof. For example, the antigen binding polypeptide or polypeptide comprised within the antigen binding complex may comprise a VH3 that specifically binds to influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, glycoprotein E1E2 of human hepatitis C virus or a combination thereof. For example, the antigen binding polypeptide or polypeptide comprised within the antigen binding complex may comprise a VH4 that specifically binds to influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, glycoprotein E1E2 of human hepatitis C virus or a combination thereof. For example, the antigen binding polypeptide or polypeptide comprised within the antigen binding complex may comprise a VH5 that specifically binds to influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, glycoprotein E1E2 of human hepatitis C virus or a combination thereof. For example, the antigen binding polypeptide or polypeptide comprised within the antigen binding complex may comprise a VH6 that specifically binds to influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, glycoprotein E1E2 of human hepatitis C virus or a combination thereof. The antigen binding polypeptide described herein or the polypeptides of the antigen binding polypeptide complex described herein may comprise any combination of VH1, VH2, VH3, VH4, VH5, VH6, VL1, VL2, VL3, VL4, VL5 and/or VL6 that bind the targets described herein. In some aspects, the antigen binding polypeptide or antigen binding polypeptide complex (e.g., antibodies or antigen binding fragments thereof) specifically binds to a viral peptide, protein, polypeptide, or a fragment of influenza virus neuraminidase. In some aspects, the antigen binding polypeptide or antigen binding polypeptide complex (e.g., antibodies or antigen binding fragments thereof) specifically binds to a viral peptide, protein, polypeptide, or a fragment of influenza virus hemagglutinin. In some aspects, the antigen binding polypeptide or antigen binding polypeptide complex (e.g., antibodies or antigen binding fragments thereof) specifically binds to a viral peptide, protein, polypeptide, or a fragment of a human respiratory syncytial virus (RSV)-viral protein. In some aspects, the antigen binding polypeptide or antigen binding polypeptide complex (e.g., antibodies or antigen binding fragments thereof) specifically binds to a viral peptide, protein, polypeptide, or a fragment of RSV F glycoprotein. In some aspects, the antigen binding polypeptide or antigen binding polypeptide complex (e.g., antibodies or antigen binding fragments thereof) specifically binds to a viral peptide, protein, polypeptide, or a fragment of RSV G glycoprotein. In some aspects, the antigen binding polypeptide or antigen binding polypeptide complex (e.g., antibodies or antigen binding fragments thereof) specifically binds to a viral peptide, protein, polypeptide, or a fragment of a herpes simplex virus (HSV) viral protein. In some aspects, the antigen binding polypeptide or antigen binding polypeptide complex (e.g., antibodies or antigen binding fragments thereof) specifically binds to a viral peptide, protein, polypeptide, or a fragment of the herpes simplex virus glycoprotein gB, gC, gD, or gE. In some aspects, the antigen binding polypeptide or antigen binding polypeptide complex (e.g., antibodies or antigen binding fragments thereof) specifically binds to a viral peptide, protein, polypeptide, or a fragment of *chlamydia* MOMP. In some aspects, the antigen binding polypeptide or antigen binding polypeptide complex (e.g., antibodies or antigen binding fragments thereof) specifically binds to a viral peptide, protein, polypeptide, or a fragment of a PorB antigen. In some aspects, the antigen binding polypeptide or antigen binding polypeptide complex (e.g., antibodies or antigen binding fragments thereof) specifically binds to a viral peptide, protein, polypeptide, or a fragment of core protein, matrix protein or other protein of Dengue virus. In some aspects, the antigen binding polypeptide or antigen binding polypeptide complex (e.g., antibodies or antigen binding fragments thereof) specifically binds to a viral peptide, protein, polypeptide, or a fragment of measles virus hemagglutinin. In some aspects, the antigen binding polypeptide or antigen binding polypeptide complex (e.g., antibodies or antigen binding fragments thereof) specifically binds to a viral peptide, protein, polypeptide, or a fragment of simplex virus type 2 glycoprotein gB. In some aspects, the antigen binding polypeptide or antigen binding polypeptide complex (e.g., antibodies or antigen binding fragments thereof) specifically binds to a viral peptide, protein, polypeptide, or a fragment of poliovirus 1 VP1. In some aspects, the antigen binding polypeptide or antigen binding polypeptide complex (e.g., antibodies or antigen binding fragments thereof) specifically binds to a viral peptide, protein, polypeptide, or a fragment of an envelope glycoprotein of HIV 1. In some aspects, the antigen binding polypeptide or antigen binding polypeptide complex (e.g., antibodies or antigen binding fragments thereof) specifically binds to a viral peptide, protein, polypeptide, or a fragment of hepatitis B surface antigen. In some aspects, the antigen binding polypeptide or antigen binding polypeptide complex (e.g., antibodies or antigen binding fragments thereof) specifically binds to a viral peptide, protein, polypeptide, or a fragment of diptheria toxin. In some aspects, the antigen binding polypeptide or antigen binding polypeptide complex (e.g., antibodies or antigen binding fragments thereof) specifically binds to a viral peptide, protein, polypeptide, or a fragment of streptococcus 24M epitope. In some aspects, the antigen binding polypeptide or antigen binding polypeptide complex (e.g., antibodies or antigen binding fragments thereof) specifically binds to a viral peptide, protein, polypeptide, or a fragment of gonococcal pilin. In some aspects, the antigen binding polypeptide or antigen binding polypeptide complex (e.g., antibodies or antigen binding fragments thereof) specifically binds to a viral peptide, protein, polypeptide, or a fragment of pseudorabies virus g50 (gpD). In some aspects, the antigen binding polypeptide or antigen binding polypeptide complex (e.g., antibodies or antigen binding fragments thereof) specifically binds to a viral peptide, protein, polypeptide, or a fragment of pseudorabies virus II (gpB). In some aspects, the antigen binding polypeptide or antigen binding polypeptide complex (e.g., antibodies or antigen binding fragments thereof) specifically binds to a viral peptide, protein, polypeptide, or a fragment of pseudorabies virus III (gpC). In some aspects, the antigen binding polypeptide or antigen binding polypeptide complex (e.g., antibodies or antigen binding fragments thereof) specifically binds to a viral peptide, protein, polypeptide, or a fragment of pseudorabies virus glycoprotein H. In some aspects, the antigen binding polypeptide or antigen binding polypeptide complex (e.g., antibodies or antigen binding fragments thereof) specifically binds to a viral peptide, protein, polypeptide, or a fragment of pseudorabies virus glycoprotein E. In some aspects, the antigen binding polypeptide or antigen binding polypeptide complex (e.g., antibodies or antigen binding fragments thereof) specifically binds to a viral peptide, protein, polypeptide, or a fragment of transmissible gastroenteritis glycoprotein 195. In some aspects, the antigen binding polypeptide or antigen binding polypeptide complex (e.g., antibodies or antigen binding fragments thereof) specifically binds to a viral peptide, protein, polypeptide, or a fragment of transmissible gastroenteritis matrix protein. In some aspects, the antigen binding polypeptide or antigen binding polypeptide complex (e.g., antibodies or antigen binding fragments thereof) specifically binds to a viral peptide, protein, polypeptide, or a fragment of swine rotavirus glycoprotein 38. In some aspects, the antigen binding polypeptide or antigen binding polypeptide complex (e.g., antibodies or antigen binding fragments thereof) specifically binds to a viral peptide, protein, polypeptide, or a fragment of swine parvovirus capsid protein. In some aspects, the antigen binding polypeptide or antigen binding polypeptide complex (e.g., antibodies or antigen binding fragments thereof) specifically binds to a viral peptide, protein, polypeptide, or a fragment of Serpulinahyododysenteriae protective antigen. In some aspects, the antigen binding polypeptide or antigen binding polypeptide complex (e.g., antibodies or antigen binding fragments thereof) specifically binds to a viral peptide, protein, polypeptide, or a fragment of bovine viral diarrhea glycoprotein 55. In some aspects, the antigen binding polypeptide or antigen binding polypeptide complex (e.g., antibodies or antigen binding fragments thereof) specifically binds to a viral peptide, protein, polypeptide, or a fragment of Newcastle disease virus hemagglutinin-neuraminidase. In some aspects, the antigen binding polypeptide or antigen binding polypeptide complex (e.g., antibodies or antigen binding fragments thereof) specifically binds to a viral peptide, protein, polypeptide, or a fragment of swine flu hemagglutinin. In some aspects, the antigen binding polypeptide or antigen binding polypeptide complex (e.g., antibodies or antigen binding fragments thereof) specifically binds to a viral peptide, protein, polypeptide, or a fragment of swine flu neuraminidase. In some aspects, the antigen binding polypeptide or antigen binding polypeptide complex (e.g., antibodies or antigen binding fragments thereof) specifically binds to a viral peptide, protein, polypeptide, or a fragment of foot and mouth disease virus. In some aspects, the antigen binding polypeptide or antigen binding polypeptide complex (e.g., antibodies or antigen binding fragments thereof) specifically binds to a viral peptide, protein, polypeptide, or a fragment of hog colera virus. In some aspects, the antigen binding polypeptide or antigen binding polypeptide complex (e.g., antibodies or antigen binding fragments thereof) specifically binds to a viral peptide, protein, polypeptide, or a fragment of swine influenza virus. In some aspects, the antigen binding polypeptide or antigen binding polypeptide complex (e.g., antibodies or antigen binding fragments thereof) specifically binds to a viral peptide, protein, polypeptide, or a fragment of African swine fever virus. In some aspects, the antigen binding polypeptide or antigen binding polypeptide complex (e.g., antibodies or antigen binding fragments thereof) specifically binds to a viral peptide, protein, polypeptide, or a fragment of Mycoplasma liyopneutiioniae. In some aspects, the antigen binding polypeptide or antigen binding polypeptide complex (e.g., antibodies or antigen binding fragments thereof) specifically binds to a viral peptide, protein, polypeptide, or a fragment of In some aspects, the antigen binding polypeptide or antigen binding polypeptide complex (e.g., antibodies or antigen binding fragments thereof) specifically binds to a viral peptide, protein, polypeptide, or a fragment of infectious bovine rhinotracheitis virus. In some aspects, the antigen binding polypeptide or antigen binding polypeptide complex (e.g., antibodies or antigen binding fragments thereof) specifically binds to a viral peptide, protein, polypeptide, or a fragment of infectious bovine rhinotracheitis virus glycoprotein E. In some aspects, the antigen binding polypeptide or antigen binding polypeptide complex (e.g., antibodies or antigen binding fragments thereof) specifically binds to a viral peptide, protein, polypeptide, or a fragment of glycoprotein G. In some aspects, the antigen binding polypeptide or antigen binding polypeptide complex (e.g., antibodies or antigen binding fragments thereof) specifically binds to a viral peptide, protein, polypeptide, or a fragment of infectious laryngotracheitis virus. In some aspects, the antigen binding polypeptide or antigen binding polypeptide complex (e.g., antibodies or antigen binding fragments thereof) specifically binds to a viral peptide, protein, polypeptide, or a fragment of an infectious laryngotracheitis virus glycoprotein G or glycoprotein I. In some aspects, the antigen binding polypeptide or antigen binding polypeptide complex (e.g., antibodies or antigen binding fragments thereof) specifically binds to a viral peptide, protein, polypeptide, or a fragment of a glycoprotein of La Crosse virus. In some aspects, the antigen binding polypeptide or antigen binding polypeptide complex (e.g., antibodies or antigen binding fragments thereof) specifically binds to a viral peptide, protein, polypeptide, or a fragment of neonatal calf diarrhoea virus. In some aspects, the antigen binding polypeptide or antigen binding polypeptide complex (e.g., antibodies or antigen binding fragments thereof) specifically binds to a viral peptide, protein, polypeptide, or a fragment of Venezuelan equine encephalomyelitis virus. In some aspects, the antigen binding polypeptide or antigen binding polypeptide complex (e.g., antibodies or antigen binding fragments thereof) specifically binds to a viral peptide, protein, polypeptide, or a fragment of punta toro virus. In some aspects, the antigen binding polypeptide or antigen binding polypeptide complex (e.g., antibodies or antigen binding fragments thereof) specifically binds to a viral peptide, protein, polypeptide, or a fragment of murine leukemia virus. In some aspects, the antigen binding polypeptide or antigen binding polypeptide complex (e.g., antibodies or antigen binding fragments thereof) specifically binds to a viral peptide, protein, polypeptide, or a fragment of mouse mammary tumor virus. In some aspects, the antigen binding polypeptide or antigen binding polypeptide complex (e.g., antibodies or antigen binding fragments thereof) specifically binds to a viral peptide, protein, polypeptide, or a fragment of hepatitis B virus core protein or hepatitis B virus surface antigen. In some aspects, the antigen binding polypeptide or antigen binding polypeptide complex (e.g., antibodies or antigen binding fragments thereof) specifically binds to a viral peptide, protein, polypeptide, or a fragment of equine influenza virus or equine herpes virus, such as equine influenza virus type A/Alaska 91 neuraminidase, equine influenza virus type A/Miami 63 neuraminidase, equine influenza virus type A/Kentucky 81 neuraminidase equine herpes virus type 1 glycoprotein B, and equine herpes virus type 1 glycoprotein D. In some aspects, the antigen binding polypeptide or antigen binding polypeptide complex (e.g., antibodies or antigen binding fragments thereof) specifically binds to a viral peptide, protein, polypeptide, or a fragment of bovine respiratory syncytial virus or bovine parainfluenza virus. In some aspects, the antigen binding polypeptide or antigen binding polypeptide complex (e.g., antibodies or antigen binding fragments thereof) specifically binds to a viral peptide, protein, polypeptide, or a fragment of bovine respiratory syncytial virus attachment protein (BRSV G). In some aspects, the antigen binding polypeptide or antigen binding polypeptide complex (e.g., antibodies or antigen binding fragments thereof) specifically binds to a viral peptide, protein, polypeptide, or a fragment of bovine respiratory syncytial virus fusion protein (BRSV F). In some aspects, the antigen binding polypeptide or antigen binding polypeptide complex (e.g., antibodies or antigen binding fragments thereof) specifically binds to a viral peptide, protein, polypeptide, or a fragment of bovine respiratory syncytial virus nucleocapsid protein (BRSVN). In some aspects, the antigen binding polypeptide or antigen binding polypeptide complex (e.g., antibodies or antigen binding fragments thereof) specifically binds to a viral peptide, protein, polypeptide, or a fragment of bovine parainfluenza virus type 3 fusion protein. In some aspects, the antigen binding polypeptide or antigen binding polypeptide complex (e.g., antibodies or antigen binding fragments thereof) specifically binds to a viral peptide, protein, polypeptide, or a fragment of ovine parainfluenza virus type 3 hemagglutinin neuraminidase. In some aspects, the antigen binding polypeptide or antigen binding polypeptide complex (e.g., antibodies or antigen binding fragments thereof) specifically binds to a viral peptide, protein, polypeptide, or a fragment of bovine E viral diarrhoea virus glycoprotein 48 or glycoprotein 53. In some aspects, the antigen binding polypeptide or antigen binding polypeptide complex (e.g., antibodies or antigen binding fragments thereof) specifically binds to a viral peptide, protein, polypeptide, or a fragment of glycoprotein E of Dengue virus. In some aspects, the antigen binding polypeptide or antigen binding polypeptide complex (e.g., antibodies or antigen binding fragments thereof) specifically binds to a viral peptide, protein, polypeptide, or a fragment of glycoprotein E1E2 of human hepatitis C virus. Any of the antigen binding polypeptide structures and any of the antigen binding polypeptide complex structures described herein may be used to target one or more of the viral targets described herein.

Sequences from antibodies or antibody fragments to known spike protein epitopes on any virus or overexpressed receptors on a cancer cell can be inserted into the constructs disclosed herein to produce multispecific multivalent polypeptides and polypeptide complexes which bind to the epitopes on the virus or virus variants and to T cells which engage the virus or cancer cell. The Immune Epitope Database and Analysis Resource provides lists of epitope sequences associated with specific antigens and infectious organism. Known VL/VH pairs and CDRs are selected and chosen to insert into a plasmid or plasmids encoding a fully functional multispecific multivalent antibody. In a preferred embodiment, the source of a preferred initial antibody or monoclonal antibody is from a highly resistant subject that has developed broadly neutralizing antibodies resistant across evolving infectious viruses or cancer cells.

Viral antigens present in Influenza A virus include matrix protein 1, hemagglutinin, nucleoprotein RNA-directed RNA polymerase catalytic subunit, polymerase acidic protein, nuclear export protein, and polymerase basic protein 2. Epitope sequences are inclusive of, for example, those selected from GILGFVFTL (SEQ ID NO:420); PKYVKFQNTLKLAT (SEQ ID NO:421); SRYWAIRTR (SEQ ID NO:422); CTELKLSDY (SEQ ID NO:423); ELRSRYWAI (SEQ ID NO:424); ILRGSVAHK (SEQ ID NO:425); VSDGGPNLY (SEQ ID NO:426); FMYSEFHFI (SEQ ID NO:427); AIMDKNIIL (SEQ ID NO:428); NML-STVLGV (SEQ ID NO:429); FLKDVMESM (SEQ ID NO:430); LPFEKSTVM (SEQ ID NO:431); and FVRQCFNPM (SEQ ID NO:432) etc. as disclosed in the above database.

Viral antigens present in Influenza B virus are selected from the group consisting of nucleoprotein, hemagglutinin; non-structural protein 1; neuraminidase and matrix protein 1. Epitopes from such proteins are selected from, for example, KLGEFYNQMM (SEQ ID NO:433); AVLLS-NEGIINSEDE (SEQ ID NO:434); AVLLSNEGIINSEDEH (SEQ ID NO:435); AYDQSGRL (SEQ ID NO:436); AYDQSGRLV (SEQ ID NO:437); FPIMHDRTKI+OX(M4) (SEQ ID NO:438); ITKNLNSLSELEVKN (SEQ ID NO:439); ITKNLNSLSELEVKNLQ (SEQ ID NO:440); LAVLLSNEGIINSEDE (SEQ ID NO:441); LAVLLSNEGI-INSEDEH (SEQ ID NO:442); and LPQSGRIVV (SEQ ID NO:443), as disclosed in the above database.

Antigens are selected from the group consisting of Influenza viruses and surface glycoproteins: H5N1 influenza: H1N1: H1N2:H3N2: HA (hemagglutinin surface glycoprotein); NA (neuraminidase surface glycoprotein); H5 and H7. Others include: Respiratory syncytial virus (RSV). Antigens associated with RSV include protein M2-1; matrix protein, fusion glycoprotein FO; nucleoprotein and small hydrophobic protein. Epitopes present on these proteins are inclusive of SYIGSINNI (SEQ ID NO:444); NAITNAKII (SEQ ID NO:445); KYKNAVTEL (SEQ ID NO:446); NSELLSLINDMPITNDQKKLMSNN (SEQ ID NO:447); NPKASLLSL (SEQ ID NO:448); VYNTVISYI (SEQ ID NO:449); TYMLTNSELL (SEQ ID NO:450): WAICK-RIPNKKPG (SEQ ID NO:451); and KNRGIIKTFSN (SEQ ID NO:452) etc.;

Chlamydia. Antigens associated with Chlamydia trachomatis include major outer membrane porin, serovar D; chaperonin GroEL; uncharacterized protein (UniProt: Q9Z7F3) probably oxidoreductase CT_610 and inclusion membrane protein A. Epitope sequences include, for example, TLNPTI (SEQ ID NO:453); ATLVVNRIRGGF (SEQ ID NO:454); LNPTIA (SEQ ID NO:455); SANN-DAEIGNLI (SEQ ID NO:456); PETISDPENRNKPSAE (SEQ ID NO:457); AEGQLG (SEQ ID NO:458); ARKLLL-DNL (SEQ ID NO:459); ASFVNPIYL (SEQ ID NO:460); DVVDGMNFNRGY (SEQ ID NO:461); NMFTPYIGV (SEQ ID NO:462), and NLVGLIGVKGS-SIAADQLPNVGIT (SEQ ID NO:463) etc.;

Adenovirdiae. Antigens associated with human adenovirus C include early EIA protein; hexon protein; DNA-binding protein; E1B 55 kDa protein and DNA polymerase. Epitope sequences include, for example, SGPSNTPPEI (SEQ ID NO:464), TDLGQNLLY (SEQ ID NO:465); LTDLGQNLLY (SEQ ID NO:466); FALSNAEDL (SEQ ID NO:467); DEPTLLYVLFEVFDV (SEQ ID NO:468); KYSPSNVKI (SEQ ID NO:469); MPNRNYIAF (SEQ ID NO:470); VDCYINLGARWSLDY (SEQ ID NO:471); VNIRNCCYI (SEQ ID NO:472); RNFQPMSRQVVDDT-KYKDYQQVGILHQHNN (SEQ ID NO:473); LPKLTP-FAL (SEQ ID NO:474); and FQRPTISSNSHAIFR (SEQ ID NO:475);

Mastadenovirus. Human mastadenovirus C has various antigens associated with viral infection. These include early EIA protein; hexon protein; DNA binding protein; E1B 55 kDa protein; DNA polymerase and fiber protein. Epitope sequences are inclusive of, for example, SGPSNTPPEI (SEQ ID NO:476); TDLGQNLLY (SEQ ID NO:477); LTDLGQNLLY (SEQ ID NO:478); FALSNAEDL (SEQ ID NO:479); DEPTLLYVLFEVFDV (SEQ ID NO:480); KYSPSNVKI (SEQ ID NO:481); MPNRPNYIAF (SEQ ID NO:482); VDCYINLGARWSLDY (SEQ ID NO:483); LPKLTPFAL (SEQ ID NO:484); FQRPTISSNSHAIFR (SEQ ID NO:485) and GKYT 1LTFATNSYTPSYIAQE (SEQ ID NO:486);

Aviadenovirus. Fowl adenovirus C has hexon protein as one of the antigens with epitopes DYDDYNIGTT (SEQ ID NO:487); KISGVFPNP (SEQ ID NO:488); PLAPKESMFN (SEQ ID NO:489); and ETLLIEDDVSGQGKELGVNLN-PAGPITADEQGL (SEQ ID NO:490) among others;

Herpesviridae. Antigens depend upon particular organism with human herpesvirus 5 (human cytomegalovirus) and human herpesvirus 4 (Epstein Barr Virus) being predominant focus with antigens ranging from 65 kDa phosphoprotein; mRNA export factor ICP27 homolog; envelope glycoprotein B; latent membrane protein 2; Epstein-Barr nuclear antigen 3; M123; trans-activitor protein BZLF1; immediate early protein 1E1; Epstein-Barr nuclear antigen 4; Epstein-Barr nuclear antigen 1; DNA polymerase processivity factor; ribonucleoside-diphosphate reductase large subunit-like protein; replication and transcription activator; and latent membrane protein 1 with epitope sequences selected from, for example, NLVPMVATV (SEQ ID NO:491); GLCTL-VAML (SEQ ID NO:492); TPRVTGGGAM (SEQ ID NO:493); SSIEFARL (SEQ ID NO:494); CLGGLLTMV (SEQ ID NO:495); FLRGRAYGL (SEQ ID NO:496); TPHFMPTNL (SEQ ID NO:497); RAKFKQLL (SEQ ID NO:498); RPPIFIRRL (SEQ ID NO:499); VLEETSVML (SEQ ID NO:500); IVTDFSVIK (SEQ ID NO:501); IPS-INVHHY (SEQ ID NO:502); QYDPVAALF (SEQ ID NO:503); HPVGEADYFEY (SEQ ID NO:504); VTEHDTLLY (SEQ ID NO:505); HGIRNASFI (SEQ ID NO:506); AVFDRKSDAK (SEQ ID NO:507); TPL-HEQHGM (SEQ ID NO:508); YSEHPTFTSQY (SEQ ID NO:509); YVLDHLIVV (SEQ ID NO:510); YLLEMLWRL (SEQ ID NO:511); FLYALALLL (SEQ ID NO:512); QAKWRLQTL (SEQ ID NO:513); ELRRKMMYM (SEQ ID NO:514); and RPHERNGFTVL (SEQ ID NO:515);

Herpes simplex virus 1 (human herpesvirus 1). Antigens include envelope glycoprotein B; ribonucleoside-diphosphate reductase large subunit; envelope glycoprotein D; tegument protein UL46; mRNA export factor; capsid vertex component 2 and ribonucleoside-diphosphate reductase small subunit. Epitope sequences include SSIEFARL (SEQ ID NO:516); QTFDRGRL (SEQ ID NO:517); SLK-MADPNRFRGKDLP (SEQ ID NO:518); QPPSL-PITVYYAVLERACTSVLLNAPSEAPQIVR (SEQ ID NO:519); RLNELLAYV (SEQ ID NO:520); RMLGDVMAV (SEQ ID NO:521); KYALADASLK-MADPNRFRGKDLP (SEQ ID NO:522); SLPITVTTA (SEQ ID NO:523); DPEDSALL (SEQ ID NO:524); and DYATLGVGV (SEQ ID NO:525);

Herpes simplex virus 2 (human herpesvirus 2). Antigens include Tegument protein VP22; envelope glycoprotein B; tegument protein VP16; Tegument protein UL47; tegument protein UL46; tegument protein VP16; envelope glycoprotein G; capsid vertex component 2; capsid scaffolding protein; envelope glycoprotein D; mRNA export factor; major viral transcription factor ICP4 homolog with antigen epitope sequences selected from, for example, RPRGEVRFL (SEQ ID NO:526); SSIEFARL (SEQ ID NO:527); EEVDMT-PADALDDFD (SEQ ID NO:528); GLADTVVAC (SEQ ID NO:529); ASDSLNNEY (SEQ ID NO:530); DFEFEQMFTDAMG (SEQ ID NO:531); EVDMTPADAL (SEQ ID NO:532); PEEFEGAGDGEPPEDDDS (SEQ ID NO:533); FLWEDQTLL (SEQ ID NO:534); FLV-DAIVRVA (SEQ ID NO:535); GPADAPPGSPAPPPPEH-RGG (SEQ ID NO:536); GPHETITAL (SEQ ID NO:537); KYALADPSLKMADPNRFRGKNLP (SEQ ID NO:538); NNYGSTIEGLL (SEQ ID NO:539); PEEFEGAGDGEPPEDDDSAT (SEQ ID NO:540); PPLYATGRLSQAQLMPSPPM (SEQ ID NO:541);

TQPELVPEDPED (SEQ ID NO:542); YTSTLLP-PELSDTTN (SEQ ID NO:543): DPSLKMADPNR-FRGKNLPVL (SEQ ID NO:544); PELVPEDPED-SALLEDPAGT (SEQ ID NO:545); HGPSLYRTF (SEQ ID NO:546); NKRVFCAAVGRLA (SEQ ID NO:547); PMRARPRGEVRFL (SEQ ID NO:548); VFCAAVGRL (SEQ ID NO:549); and LGNRLCGPATAAWAG (SEQ ID NO:550) and as further disclosed in the Immune Epitope database.

Herpes simplex virus 5 (human herpesvirus 5). Antigens include 65 kDa phosphoprotein; immediate early protein 1E1; envelope glycoprotein H; other human herpesvirus 5 protein and envelope glycoprotein B. Epitope sequences include NLVPMVATV (SEQ ID NO:551); TMYGGISLL (SEQ ID NO:552); VLEETSVML (SEQ ID NO:553); LDPHAFHLLL (SEQ ID NO:554); RIFAELEGV (SEQ ID NO:555); RPHERNGFTVL (SEQ ID NO:556); VFPTKDVAL (SEQ ID NO:557); VLAELVKQI (SEQ ID NO:558); VLPHETRLL (SEQ ID NO:559); KRLDVCRAKMGYM (SEQ ID NO:560); GGGAMA-GASTSAGRKRKS (SEQ ID NO:561); AALFFFDID (SEQ ID NO:562); AGILARNLVPMVATV (SEQ ID NO:563); ALFFFDIDLL (SEQ ID NO:564); ANETIYNTTLKYGDV (SEQ ID NO:565); ARAKKDELRRKMMYM (SEQ ID NO:566); ARNLVPMVATVQGQN (SEQ ID NO:567); ASTAAPPYTNEQAYQMLLAL (SEQ ID NO:568); AVG-GAVASV (SEQ ID NO:569); DEEEAIVAYT (SEQ ID NO:570); DEEEAIVAYTL (SEQ ID NO:571); DPVAALFFF (SEQ ID NO:572); EEAIVAYTL (SEQ ID NO:573); EECQLPSLKIFIAGNSAY (SEQ ID NO:574) or EEEAIVAYTL (SEQ ID NO:575) and others disclosed in public databases such as the Immune Epitope database;

Other antigens include Herpes simplex virus 6; Leviviridae; Levivirus; Enterobacteria phase MS2; Allolevirus; Poxviridae; Chordopoxvirinae (cowpox virus or vaccinia virus); antigens include CPXV202 protein; intermediate transcription factor 3 small subunit; putative nuclease G5; interferon antagonist C7; protein A47; major core protein 4b; DNA directed RNA polymerase 147 kDa polypeptide; mRNA capping enzyme regulatory subunit; envelope protein H3; protein B6; telomere binding protein I1; protein K3; poxin; protein A19; assembly protein G7; frotein F12; protein A46; protein A6; DNA polymerase; profiling; RNA binding protein E3; and serine protease inhibitor 1. The antigens have epitope sequences selected from TSYKFESV (SEQ ID NO:576); ITYRFYLI (SEQ ID NO:577); ILDDNLYKV (SEQ ID NO:578); KVDDTFYYV (SEQ ID NO:579); AAFEFINSL (SEQ ID NO:580); KSYNYMLL (SEQ ID NO:581); MPAYIRNTL (SEQ ID NO:582); RVYEALYYV (SEQ ID NO:583); IGMFNLTFI (SEQ ID NO:584); SLSAYIIRV (SEQ ID NO:585); LMYDIINSV (SEQ ID NO:586); RLYDYFTRV (SEQ ID NO:587); YSLPNAGDVI (SEQ ID NO:588); YSQVNKRYI (SEQ ID NO:589); VSLDYINTM (SEQ ID NO:590); TLPEVISTI (SEQ ID NO:591); FLTSVINRV (SEQ ID NO:592); GFFDFVNFV (SEQ ID NO:593); VLYDEFVTI (SEQ ID NO:594); FPYEGGKVF (SEQ ID NO:595); LMDEN-TYAM (SEQ ID NO:596); NLFDIPLLTV (SEQ ID NO:597); VGPSNSPTF (SEQ ID NO:598); YAPVSPIVI (SEQ ID NO:599) and HVDGKILFV (SEQ ID NO:600).

Parapoxvirus (orf virus). Antigens include uncharacterized protein; ORF011 putative EEV envelope phospholipase; ORF052 putative IMV membrane protein; ORF110 EEV glycoprotein; ORF094 putative phosphorylated IMV membrane protein; ORF056RNA polymerase subunit RP0147; ORF101 RNA polymerase subunit RP0132 having epitope sequences AAFEFRDL (SEQ ID NO:601);

AIIKYTDL (SEQ ID NO:602); AIYAFRLT (SEQ ID NO:603); AIYGFGVTF (SEQ ID NO:604); ANVDFMEYV (SEQ ID NO:605); and EQFSFSNV (SEQ ID NO:606). Other antigens and their associated antibodies and antibody fragments which bind to epitopes include Avipoxvirus; Capripoxvirus; Leporiipoxvirus; Suipoxvirus; Molluscipoxvirus; Entomopoxvirinae; Papovaviridae; Polyomavirus; Papillomavirus; Paramyxoviridae; Paramyxovirus; Parainfluenza virus 1; Morbillivirus; Measles virus; Rubulavirus; Mumps virus; Pneumonovirinae; Pneumovirus; Metapneumovirus; Avian pneumovirus; Human metapneumovirus; Picornaviridae, and Enterovirus (enterovirus A, coxsackievirus A). Antigen includes genome polyprotein having epitopes selected from TYTFGEHKQEKDLEY (SEQ ID NO:607); TEDSHPPYKQTQPGA (SEQ ID NO:608); PES-RESLAWQTATNP (SEQ ID NO:609); FGEHKQEKDL (SEQ ID NO:610); AGGTGTEDSHPPYKQ (SEQ ID NO:611); FGEHKQEKDL (SEQ ID NO:612); AGGTGT-EDSHPPYKQ (SEQ ID NO:613); FGEHKQEKDLEYGAC (SEQ ID NO:614); HYRAHARDGVFDYYT (SEQ ID NO:615); KQEDK (SEQ ID NO:616); GDPIAD-MIDQTVNNQ (SEQ ID NO:617); YPTFGEHLQANDLDY (SEQ ID NO:618); LEGTTNPNT (SEQ ID NO:619); VSSHRLDDTGEVPALQ (SEQ ID NO:620); RIYMRMKHVR (SEQ ID NO:621); TSKSKY-PLVV (SEQ ID NO:622); and DGYPTFGEHKQEKDL (SEQ ID NO:623);

Rhinovirus and Hepatovirus. Human hepatitis A virus (hepatovirus A) with genome polyproteins as an antigen with epitopes YMYAVS GAL (SEQ ID NO:624); FWRGDLVFDFQV (SEQ ID NO:625); MNMSKQ-GIFQTVGSGLDHILSLA (SEQ ID NO:626); TVSTE-QNVPDPQVGI (SEQ ID NO:627); ASICQMFCFWRGDLVFDFQV (SEQ ID NO:628); DHM-SIYKFMGRSHFLCTFTF (SEQ ID NO:629); FPELKPGESTHTSDHMSIYK (SEQ ID NO:630) and as additionally disclosed in the IED. Others are inclusive of Cardiovirus; Andapthovirus, Reoviridae, Orthoreovirus; Orbivirus; Rotavirus; Cypovirus; Fijivirus, phytoreovirus; oryzavirus; retroviridae; mammalian type B retrovirus; mammalian type C retroviruses; avian type C retroviruses; type D retrovirus group; BLV-HTLV retroviruses; Lentivirus; Human immunodeficiency virus 1; Human immunodeficiency virus 2; HTLV-I and II viruses; Herpes simplex virus; Epstein Barr virus; Cytomegalovirus; Hepatitis virus (HCV, HAV, HBV, HDV, HEV); *Toxoplasma gondii* virus, Treponema pallidium virus; Human T-lymphotrophic virus; Encephalitis virus; West Nile virus; Dengue virus; Varicella Zoster virus; Rubeola, mumps, rubella, spumavirus, flaviviridae, hepatitis C virus; hepadnaviridae, hepatitis B virus; togaviridae, alphavirus sindbis virus; rubivirus; rubella virus, rhabdovridae, vesiculovirus; lyssavirus, ephemerovirus, cytohabdovirus, necleorhabdovirus, arenaviridae, arenavirus, lymphocytic choriomenigitis virus; Ippy virus; Lassa virus; and Torovirus.

Thus, the recited multispecific and multivalent antibody constructs have embedded sequences that target and bind to epitopes on viral peptides, proteins, polypeptides or glycosylated versions thereof in a subject in need of treatment thereof, wherein said viral peptides, proteins, polypeptides or glycosylated versions thereof are selected from the group consisting of influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diphtheria toxin, streptococcus 24 M epitope, gonococcal pilin, pseudorabies virus g50 (gpD), pseudorabies virus II (gpB), pseudorabies virus III (gpC), pseudorabides virus glycoprotein H, pseudorabies virus glycoprotein E, transmissible gastroenteritis glycoprotein 195, transmissible gastroenteritis matrix protein, swine rotavirus glycoprotein 38, swine parvovirus capside protein, serpulinahydodysenteriae protective antigen, govine viral diarrhea glycoprotein 55, Newcastle disease virus hemagglutinin-neuroaminidase, swine flu hemagglutinin, swine flue neuraminidase, foot and mouth disease virus, hog colera virus, swine influenza virus, African swine fever virus, Mycoplasma liyopneutiinniae, infections bovine rhinotracheitis virus, infection bovine rhinotracheitis virus glycoprotein e, glycoprotein G, infectiouls laryngotracheitis virus, infectious laryngotracheitis virus glycoprotein G or glycoprotein I, a glycoprotein of Las Cross virus, neonatal calf diarrhea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapside protein (BRSVN), bovine parainfluenza virus type 3 fusion protein, bovine parainfluenza virus type 3 hemagglutinin neuraminidase, bovine viral diarrhea virus glycoprotein 48 and glycoprotein 53, glycoprotein E of Dengue virus, and glycoprotein E1E2 of human hepatitis C virus. For example, said viral peptides, proteins, polypeptides or glycosylated versions thereof are selected from the group consisting of: influenza virus neuraminidase, influenza virus hemagglutinin, herpes simplex virus (HSV) viral proteins, core protein, matrix protein or other protein of Dengue virus, and swine influenza viral proteins.

All the antigen binding polypeptide structures described herein and all the antigen binding polypeptide complex structures described herein can specifically bind to one or more of the viral antigen targets described herein, namely one or more of (such as two or more, three or more or four of): influenza virus neuraminidase, influenza virus hemagglutinin, herpes simplex virus (HSV) viral proteins, core protein, matrix protein or other protein of Dengue virus, and swine influenza viral proteins.

In some aspects, the antigen binding polypeptide and the antigen binding polypeptide complex can specifically bind to influenza virus neuraminidase. In some aspects, the antigen binding polypeptide or the antigen binding polypeptide complex comprises a VL1 that specifically binds to influenza virus neuraminidase. In some aspects, the antigen binding polypeptide or the antigen binding polypeptide complex comprises a VL2 that specifically binds to influenza virus neuraminidase. In some aspects, the antigen binding polypeptide or the antigen binding polypeptide complex comprises a VH1 that specifically binds to influenza virus neuraminidase. In some aspects, the antigen binding polypeptide or the antigen binding polypeptide complex comprises a VH2 that specifically binds to influenza virus neuraminidase. In some aspects, the antigen binding polypeptide and the antigen binding polypeptide complex can specifically bind to influenza virus hemagglutinin. In some aspects, the antigen binding polypeptide or the antigen binding polypeptide complex comprises a VL1 that specifically binds to influenza virus hemagglutinin. In some aspects, the antigen binding polypeptide or the antigen binding polypeptide complex comprises a VL2 that specifically binds to influenza virus hemagglutinin. In some aspects, the antigen binding polypeptide or the antigen binding polypeptide complex comprises a VH1 that specifically binds to influenza virus hemagglutinin. In some aspects, the antigen binding polypeptide or the antigen binding polypeptide complex comprises a VH2 that specifically binds to influenza virus hemagglutinin. In some aspects, the antigen binding polypeptide and the antigen binding polypeptide complex can specifically bind to herpes simplex virus (HSV) viral proteins. In some aspects, the antigen binding polypeptide or the antigen binding polypeptide complex comprises a VL1 that specifically binds to herpes simplex virus (HSV) viral proteins. In some aspects, the antigen binding polypeptide or the antigen binding polypeptide complex comprises a VL2 that specifically binds to herpes simplex virus (HSV) viral proteins. In some aspects, the antigen binding polypeptide or the antigen binding polypeptide complex comprises a VH1 that specifically binds to herpes simplex virus (HSV) viral proteins. In some aspects, the antigen binding polypeptide or the antigen binding polypeptide complex comprises a VH2 that specifically binds to herpes simplex virus (HSV) viral proteins. In some aspects, the antigen binding polypeptide and the antigen binding polypeptide complex can specifically bind to gue virus. In some aspects, the antigen binding polypeptide or the antigen binding polypeptide complex comprises a VL1 that specifically binds to Dengue virus. In some aspects, the antigen binding polypeptide or the antigen binding polypeptide complex comprises a VL2 that specifically binds to Dengue virus. In some aspects, the antigen binding polypeptide or the antigen binding polypeptide complex comprises a VH1 that specifically binds to Dengue virus. In some aspects, the antigen binding polypeptide or the antigen binding polypeptide complex comprises a VH2 that specifically binds to Dengue virus. In some aspects, the antigen binding polypeptide and the antigen binding polypeptide complex can specifically bind to swine influenza virus. In some aspects, the antigen binding polypeptide described herein or the antigen binding polypeptide complex described herein comprises a VL1 that specifically binds to swine influenza virus. In some aspects, the antigen binding polypeptide described herein or the antigen binding polypeptide complex described herein comprises a VL2 that specifically binds to swine influenza virus. In some aspects, the antigen binding polypeptide described herein or the antigen binding polypeptide complex described herein comprises a VH1 that specifically binds to swine influenza virus. In some aspects, the antigen binding polypeptide described herein or the antigen binding polypeptide complex described herein comprises a VH2 that specifically binds to swine influenza virus.

In some aspects, the antigen binding polypeptide and antigen binding polypeptide complex of the invention specifically bind to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD16A, CD19, CD20, CD24, CD27, CD28, CD30, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DLL4, DNGR-1, E-cadherin, EGFR, ENTPD1, EpCAM, FCER1, FCER1A, FCER2, FGFR, FLAP, FOLH1, Gi24, GITR, GITRL, GPR5, GP100, GPRC5D, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, 118, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, TGFbeta, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, or WUCAM, or any combination thereof. In some aspects, the antigen binding polypeptide or antigen binding polypeptide complex specifically binds at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A. In some aspects, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For example, the antigen binding polypeptide or polypeptide comprised within the antigen binding complex may comprise a VL1 that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TGFbeta, GP100, GPRC5D, CD30 or CD16A. For example, the antigen binding polypeptide or polypeptide comprised within the antigen binding complex may comprise a VL2 that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For example, the antigen binding polypeptide or polypeptide comprised within the antigen binding complex may comprise a VL3 that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For example, the antigen binding polypeptide or polypeptide comprised within the antigen binding complex may comprise a VL4 that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For example, the antigen binding polypeptide or polypeptide comprised within the antigen binding complex may comprise a VL5 that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For example, the antigen binding polypeptide or polypeptide comprised within the antigen binding complex may comprise a VL6 that specifi-cally binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For example, the antigen binding polypeptide or polypeptide comprised within the antigen binding complex may comprise a VH1 that specifi-cally binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For example, the antigen binding polypeptide or polypeptide comprised within the antigen binding complex may comprise a VH2 that specifi-cally binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For example, the antigen binding polypeptide or polypeptide comprised within the antigen binding complex may comprise a VH3 that specifi-cally binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For example, the antigen binding polypeptide or polypeptide comprised within the antigen binding complex may comprise a VH4 that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For example, the antigen binding polypeptide or polypeptide comprised within the antigen binding complex may comprise a VH5 that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For example, the antigen binding polypeptide or polypeptide comprised within the antigen binding complex may comprise a VH6 that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, 114, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. The antigen binding polypeptide described herein or the polypeptides of the antigen binding polypeptide complex described herein may comprise any combination of VH1, VH2, VH3, VH4, VH5, VH6, VL1, VL2, VL3, VL4, VL5 and/or VL6 that bind the targets described herein. For example, VH1, VH2, VH3, VH4, VH5, VH6, VL1, VL2, VL3, VL4, VL5 and/or VL6 may specifically bind one or more of: CD3, CD28, CD38, CD19, CD20, Trop2 and cMet. For example, VL1 may specifically bind CD3. For example, VL1 may specifically bind CD19. For example, VL1 may specifically bind HER2. For example, VL1 may specifically bind CD2O. For example, VL1 may specifically bind CD28. For example, VL1 may specifically bind CD38. For example, VL1 may specifically bind Trop2. For example, VL1 may specifically bind cMet. For example, VL2 may specifically bind CD3. For example, VL2 may specifically bind CD19. For example, VL2 may specifically bind HER2. For example, VL2 may specifically bind CD2O. For example, VL2 may specifically bind CD28. For example, VL2 may specifically bind CD38. For example, VL2 may specifically bind Trop2. For example, VL2 may specifically bind cMet. For example, VL3 may specifically bind CD3. For example, VL3 may specifically bind CD19. For example, VL3 may specifically bind HER2. For example, VL3 may specifically bind CD2O. For example, VL3 may specifically bind CD28. For example, VL3 may specifically bind CD38. For example, VL3 may specifically bind Trop2. For example, VL3 may specifically bind cMet. For example, VL4 may specifically bind CD3. For example, VL4 may specifically bind CD19. For example, VL4 may specifically bind HER2. For example, VL4 may specifically bind CD2O. For example, VL4 may specifically bind CD28. For example, VL4 may specifically bind CD38. For example, VL4 may specifically bind Trop2. For example, VL4 may specifically bind cMet. For example, VL5 may specifically bind CD3. For example, VL5 may specifically bind CD19. For example, VL5 may specifically bind HER2. For example, VL5 may specifically bind CD2O. For example, VL5 may specifically bind CD28. For example, VL5 may specifically bind CD38. For example, VL5 may specifically bind Trop2. For example, VL5 may specifically bind cMet. For example, VL6 may specifically bind CD3. For example, VL6 may specifically bind CD19. For example, VL6 may specifically bind HER2. For example, VL6 may specifically bind CD2O. For example, VL6 may specifically bind CD28. For example, VL6 may specifically bind CD38. For example, VL6 may specifically bind Trop2. For example, VL6 may specifically bind cMet. For example, VH1 may specifically bind CD3. For example, VH1 may specifically bind CD19. For example, VH1 may specifically bind HER2. For example, VH1 may specifically bind CD2O. For example, VH1 may specifically bind CD28. For example, VH1 may specifically bind CD38. For example, VH1 may specifically bind Trop2. For example, VH1 may specifically bind cMet. For example, VH2 may specifically bind CD3. For example, VH2 may specifically bind CD19. For example, VH2 may specifically bind HER2. For example, VH2 may specifically bind CD20. For example, VH2 may specifically bind CD28. For example, VH2 may specifically bind CD38. For example, VH2 may specifically bind Trop2. For example, VH2 may specifically bind cMet. For example, VH3 may specifically bind CD3. For example, VH3 may specifically bind CD19. For example, VH3 may specifically bind HER2. For example, VH3 may specifically bind CD20. For example, VH3 may specifically bind CD28. For example, VH3 may specifically bind CD38. For example, VH3 may specifically bind Trop2. For example, VH3 may specifically bind cMet. For example, VH4 may specifically bind CD3. For example, VH4 may specifically bind CD19. For example, VH4 may specifically bind HER2. For example, VH4 may specifically bind CD20. For example, VH4 may specifically bind CD28. For example, VH4 may specifically bind CD38. For example, VH4 may specifically bind Trop2. For example, VH4 may specifically bind cMet. For example, VH5 may specifically bind CD3. For example, VH5 may specifically bind CD19. For example, VH5 may specifically bind HER2. For example, VH5 may specifically bind CD20. For example, VH5 may specifically bind CD28. For example, VH5 may specifically bind CD38. For example, VH5 may specifically bind Trop2. For example, VH5 may specifically bind cMet. For example, VH6 may specifically bind CD3. For example, VH6 may specifically bind CD19. For example, VH6 may specifically bind HER2. For example, VH6 may specifically bind CD20. For example, VH6 may specifically bind CD28. For example, VH6 may specifically bind CD38. For example, VH6 may specifically bind Trop2. For example, VH6 may specifically bind cMet. In some aspects, the VH1 and VL1 of the antigen binding polypeptide or antigen binding polypeptide complex specifically binds to CD28, VH2 and VL2 specifically bind to CD3, and VH3 and VL3 specifically bind to CD38. In some aspects, the VH1 and VL1 of the antigen binding polypeptide or antigen binding polypeptide complex specifically binds to CD28, VH2 and VL2 specifically bind to CD38, and VH3 and VL3 specifically bind to CD3. In some aspects, the VH1 and VL1 of the antigen binding polypeptide or antigen binding polypeptide complex specifically binds to CD3, VH2 and VL2 specifically bind to CD38, and VH3 and VL3 specifically bind to CD28. In some aspects, the VH1 and VL1 of the antigen binding polypeptide or antigen binding polypeptide complex specifically binds to CD3, VH2 and VL2 specifically bind to CD28, and VH3 and VL3 specifically bind to CD38. In some aspects, the VH1 and VL1 of the antigen binding polypeptide or antigen binding polypeptide complex specifically binds to CD38, VH2 and VL2 specifically bind to CD28, and VH3 and VL3 specifically bind to CD3. In some aspects, the VH1 and VL1 of the antigen binding polypeptide or antigen binding polypeptide complex specifically binds to CD38, VH2 and VL2 specifically bind to CD3, and VH3 and VL3 specifically bind to CD28. In some aspects, the VH1 and VL1 of the antigen binding polypeptide or antigen binding polypeptide complex specifically binds to CD28, VH2 and VL2 specifically bind to CD19, and VH3 and VL3 specifically bind to CD38. In some aspects, the VH1 and VL1 of the antigen binding polypeptide or antigen binding polypeptide complex specifically binds to CD28, VH2 and VL2 specifically bind to CD38, and VH3 and VL3 specifically bind to CD19. In some aspects, the VH1 and VL1 of the antigen binding polypeptide or antigen binding polypeptide complex specifically binds to CD19, VH2 and VL2 specifically bind to CD38, and VH3 and VL3 specifically bind to CD28. In some aspects, the VH1 and VL1 of the antigen binding polypeptide or antigen binding polypeptide complex specifically binds to CD19, VH2 and VL2 specifically bind to CD28, and VH3 and VL3 specifically bind to CD38. In some aspects, the VH1 and VL1 of the antigen binding polypeptide or antigen binding polypeptide complex specifically binds to CD38, VH2 and VL2 specifically bind to CD28, and VH3 and VL3 specifically bind to CD19. In some aspects, the VH1 and VL1 of the antigen binding polypeptide or antigen binding polypeptide complex specifically binds to CD38, VH2 and VL2 specifically bind to CD19, and VH3 and VL3 specifically bind to CD28. For example, the invention is directed to an antigen binding polypeptide or antigen binding polypeptide complex that specifically binds to EGFR and cMet. For example, the invention is directed to an antigen binding polypeptide or antigen binding polypeptide complex that specifically binds to GP100 and CD3. For example, the invention is directed to an antigen binding polypeptide or antigen binding polypeptide complex that specifically binds to CD20 and CD3. For example, the invention is directed to an antigen binding polypeptide or antigen binding polypeptide complex that specifically binds to BCMA and CD3. For example, the invention is directed to an antigen binding polypeptide or antigen binding polypeptide complex that specifically binds to PDL1 and CTLA4. For example, the invention is directed to an antigen binding polypeptide or antigen binding polypeptide complex that specifically binds to PD1 and LAG3. For example, the invention is directed to an antigen binding polypeptide or antigen binding polypeptide complex that specifically binds to PD1 and VEGF For example, the invention is directed to an antigen binding polypeptide or antigen binding polypeptide complex that specifically binds to DLL4 and VEGF. For example, the invention is directed to an antigen binding polypeptide or antigen binding polypeptide complex that specifically binds to EGFR and HER3. For example, the invention is directed to an antigen binding polypeptide or antigen binding polypeptide complex that specifically binds to HER2. For example, the invention is directed to an antigen binding polypeptide or antigen binding polypeptide complex that specifically binds to EpCAM and CD3. For example, the invention is directed to an antigen binding polypeptide or antigen binding polypeptide complex that specifically binds to PDL1 and TGFbeta. For example, the invention is directed to an antigen binding polypeptide or antigen binding polypeptide complex that specifically binds to PDL1 and TEF beta. For example, the invention is directed to an antigen binding polypeptide or antigen binding polypeptide complex that specifically binds to GPRC5D and CD3. For example, the invention is directed to an antigen binding polypeptide or antigen binding polypeptide complex that specifically binds to CD123 and CD3. For example, the invention is directed to an antigen binding polypeptide or antigen binding polypeptide complex that specifically binds to CD30 and CD16A. For example, the invention is directed to an antigen binding polypeptide or antigen binding polypeptide or antigen binding polypeptide complex that specifically binds to DLL3 and CD3.

For example, the antigen binding polypeptide or antigen binding polypeptide complex specifically binds at least one epitope on each of EGFR and cMet. For example, the antigen binding polypeptide or antigen binding polypeptide complex specifically binds at least one epitope on each of GP100 and CD3. For example, the antigen binding polypeptide or antigen binding polypeptide complex specifically binds at least one epitope on each of CD20 and CD3. For example, the antigen binding polypeptide or antigen binding polypeptide complex specifically binds at least one epitope on each of BCMA and CD3. For example, the antigen binding polypeptide or antigen binding polypeptide complex specifically binds at least one epitope on each of PDL1 and CTLA4. For example, the antigen binding polypeptide or antigen binding polypeptide complex specifically binds at least one epitope on each of PD1 and LAG3. For example, the antigen binding polypeptide or antigen binding polypeptide complex specifically binds at least one epitope on each of PD1 and VEGF. For example, the antigen binding polypeptide or antigen binding polypeptide complex specifically binds at least one epitope on each of DLL4 and VEGF. For example, the antigen binding polypeptide or antigen binding polypeptide complex specifically binds at least one epitope on each of EGFR and HER3. For example, the antigen binding polypeptide or antigen binding polypeptide complex specifically binds at least one epitope on HER2. For example, the antigen binding polypeptide or antigen binding polypeptide complex specifically binds at least one epitope on each of EpCAM and CD3. For example, the antigen binding polypeptide or antigen binding polypeptide complex specifically binds at least one epitope on each of PDL1 and TGFbeta. For example, the antigen binding polypeptide or antigen binding polypeptide complex specifically binds at least one epitope on each of PDL1 and TEF beta. For example, the antigen binding polypeptide or antigen binding polypeptide complex specifically binds at least one epitope on each of GPRC5D and CD3. For example, the antigen binding polypeptide or antigen binding polypeptide complex specifically binds at least one epitope on each of CD123 and CD3. For example, the antigen binding polypeptide or antigen binding polypeptide complex specifically binds at least one epitope on each of CD30 and CD16A. For example, the antigen binding polypeptide or antigen binding polypeptide complex specifically binds at least one epitope on each of DLL3 and CD3.

For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to EGFR and a VL1, VL2, VL3, VL4, VL5, VL6, VH1, VH2, VH3, VH4, VH5 and/or VH6 that specifically binds to cMet. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to GP100 and a VL1, VL2, VL3, VL4, VL5, VL6, VH1, VH2, VH3, VH4, VH5 and/or VH6 that specifically binds to CD3. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to CD20 and a VL1, VL2, VL3, VL4, VL5, VL6, VH1, VH2, VH3, VH4, VH5 and/or VH6 that specifically binds to CD3. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to BCMA and a VL1, VL2, VL3, VL4, VL5, VL6, VH1, VH2, VH3, VH4, VH5 and/or VH6 that specifically binds to CD3. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to PDL1 and a VL1, VL2, VL3, VL4, VL5, VL6, VH1, VH2, VH3, VH4, VH5 and/or VH6 that specifically binds to CTLA4. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to PD1 and a VL1, VL2, VL3, VL4, VL5, VL6, VH1, VH2, VH3, VH4, VH5 and/or VH6 that specifically binds to LAG3. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to PD1 and a VL1, VL2, VL3, VL4, VL5, VL6, VH1, VH2, VH3, VH4, VH5 and/or VH6 that specifically binds to VEGF. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to DLL4 and a VL1, VL2, VL3, VL4, VL5, VL6, VH1, VH2, VH3, VH4, VH5 and/or VH6 that specifically binds to VEGF. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to EGFR and a VL1, VL2, VL3, VL4, VL5, VL6, VH1, VH2, VH3, VH4, VH5 and/or VH6 that specifically binds to HER3. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to HER2 and a VL1, VL2, VL3, VL4, VL5, VL6, VH1, VH2, VH3, VH4, VH5 and/or VH6 that specifically binds to HER2. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to EpCAM and a VL1, VL2, VL3, VL4, VL5, VL6, VH1, VH2, VH3, VH4, VH5 and/or VH6 that specifically binds to CD3. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to PDL1 and a VL1, VL2, VL3, VL4, VL5, VL6, VH1, VH2, VH3, VH4, VH5 and/or VH6 that specifically binds to TGFbeta. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to PDL1 and a VL1, VL2, VL3, VL4, VL5, VL6, VH1, VH2, VH3, VH4, VH5 and/or VH6 that specifically binds to TEF beta. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to GPRC5D and a VL1, VL2, VL3, VL4, VL5, VL6, VH1, VH2, VH3, VH4, VH5 and/or VH6 that specifically binds to CD3. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to CD123 and a VL1, VL2, VL3, VL4, VL5, VL6, VH1, VH2, VH3, VH4, VH5 and/or VH6 that specifically binds to CD3. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to CD30 and a VL1, VL2, VL3, VL4, VL5, VL6, VH1, VH2, VH3, VH4, VH5 and/or VH6 that specifically binds to CD16A. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to DLL3 and a VL1, VL2, VL3, VL4, VL5, VL6, VH1, VH2, VH3, VH4, VH5 and/or VH6 that specifically binds to CD3.

In other aspects, the invention is directed to an antigen binding polypeptide or antigen binding polypeptide complex that specifically binds to Ang-2 and VEGF-A. For example, the antigen binding polypeptide or antigen binding polypeptide complex specifically binds at least one epitope on each of Ang-2 and VEGF-A. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to Ang-2 and a VL1, VL2, VL3, VL4, VL5, VL6, VH1, VH2, VH3, VH4, VH5 and/or VH6 that specifically binds to VEGF-A.

In other aspects, the invention is directed to an antigen binding polypeptide or antigen binding polypeptide complex that specifically binds to Factor IXa and Factor X. For example, the antigen binding polypeptide or antigen binding polypeptide complex specifically binds at least one epitope on each of Factor IXa and Factor X. For example, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to Factor IXa and a VL1, VL2, VL3, VL4, VL5, VL6, VH1, VH2, VH3, VH4, VH5 and/or VH6 that specifically binds to Factor X.

Any of the antigen binding polypeptide structures and any of the antigen binding polypeptide complex structures described herein may be used to target one or more of the targets described herein.

Antigen binding sequences (e.g., CDR, VH, VL, heavy chain and light chain sequences from antibodies) for A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD16A, CD19, CD20, CD24, CD27, CD28, CD30, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DLL4, DNGR-1, E-cadherin, EGFR, ENTPD1, EpCAM, FCER1, FCER1A, FCER2, FGFR, FLAP, FOLH1, Gi24, GITR, GITRL, GPR5, GP100, GPRC5D, HER2, HER3, ICOSL, ICOS, HHLA2, HMGB1, HVEM, IDO, IFNa, IgE, IGF1R, IL2Rbeta, IL1, ILIA, 1L1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, 1L25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, TGFbeta, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, and WUCAM are well known. Such sequences include, but are not limited to, GenBank Accession Nos. AAA39272.1, AAA39159.1, ABN79462.1, AVW80143.1, AVW80142.1, AVW80141.1, AAB34430.1, AAB34429.1, CAD45042.1, 4CMH_C and 4CMH_B, and UniProt Identifiers P04626-1, P04626-2, P04626-3, P04626-4, P04626-4, P04626-5, P-04626-6, P11836, A6NMS4 and Q13963. Such sequences are also described, for example, in Wernly et al., Cells, 9(2):295, 2020; Arakawa et al., Journal of Biochemistry, 120(3):657-662, 1996; Cole et al., Transplantation, 68(4): 563-571, 1999; Li et al., International Immunopharmacology, 62:299-308, 2018; Castella et al., Methods & Clinical Development, 12:134-144, 2019; Sun et al., Molecular Immunology, 41(9):929-938, 2004; Iwaszkiewicz-Grzes et al., Cytotherapy, 22(11):629-641, 2020, Rosinski et al., Transplant Direct, 1(2):e7, 2015; Ellis et al., J. Immunology, 155(2):925-937, 1995; Stevenson et al., Blood, 77(5):1071-1079, 1991; Chillemi et al., Molecular Medicine, 19:99-108, 2013, and Int'l Pub. No. WO 2020/076853.

In addition, molecular biology and recombinant DNA methods for making, screening and engineering antigen binding complexes and antibodies containing such sequences are well known and described, for example, in Adair et al. Human Antibodies, 5(1-2):41-47, 1994; Kostelny et al., J. Immunol., 148(5):1547-1553 (1992), Shiraiwa et al., Methods, 154:10-20, 2019; and Zola, "Monoclonal Antibodies: A Manual of Techniques," 1987, 1St Ed., CRC Press; and Steinitz, Human Antibodies, 18(1-2):1-10, 2009.

In some aspects, the invention is directed to an antigen binding polypeptide or antigen binding polypeptide complex comprising a polypeptide having a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; or VH1-VL2-VL3-VH3-VH2-VL1; wherein VL1 is a first immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL2 is a second immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, 1L12, 1L13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL3 is a third immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH1 is a first immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH2 is a second immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cad-herin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; and VH3 is a third immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cad-herin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has a structure represented by VL1-VL2-VL3-VH3-VH2-VH1; wherein wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has a structure represented by VH1-VH2-VH3-VL3-VL2-VL1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has a structure represented by VL1-VH2-VL3-VH3-VL2-VH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has a structure represented by VH1-VL2-VH3-VL3-VH2-VL1; wherein wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TGFbeta, GP100, GPRC5D, CD30 or CD16A. In some aspects, the antigen binding polypeptide has a structure represented by VL1-VL2-VH3-VL3-VH2-VH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has a structure represented by VH1-VH2-VL3-VH3-VL2-VL1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has a structure represented by VL1-VH2-VH3-VL3-VL2-VH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has a structure represented by VH1-VL2-VL3-VH3-VH2-VL1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide or antigen binding polypeptide complex contains an amino acid linker between any two regions denoted in a structure described herein. In some aspects, the antigen binding polypeptide or antigen binding polypeptide complex can contain an Fc region, CH1 region, CL region or any combination thereof. Examples of an Fc region include, but are not limited to, an amino acid sequence of any one of SEQ ID NOs:389-402, or an amino acid sequence having at least 80%, at least 85%, at least 90%, at least 95%, at least 96%, at least 97%, at least 98%, or at least 99% identity to any one of SEQ ID NOs:389-402. Examples of a CH1 region include, but are not limited to, an amino acid sequence of any one of SEQ ID NOs:403-407, or an amino acid sequence having at least 80%, at least 85%, at least 90%, at least 95%, at least 96%, at least 97%, at least 98%, or at least 99% identity to any one of SEQ ID NOs:403-407. Examples of a CL region include, but are not limited to, an amino acid sequence of SEQ ID NO:418 or 419, or an amino acid sequence having at least 80%, at least 85%, at least 90%, at least 95%, at least 96%, at least 97%, at least 98%, or at least 99% identity to SEQ ID NO:418 or 419. In some aspects, the antigen binding polypeptide complex is an antibody or antigen binding fragment thereof. For the avoidance of doubt, all the antigen binding polypeptide structures described herein can be combined with any one or more of the targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VH1, VH2, and/or VH3 of each and every antigen binding polypeptide and antigen binding polypeptide complex described herein may independently bind to any one of said particularly preferred targets.

In some aspects, the antigen binding polypeptide of antigen binding polypeptide complex comprises a polypeptide having a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; wherein VL1 is a first immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, 1L5, IL5R, 1L6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL2 is a second immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, 1L13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL3 is a third immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH1 is a first immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH2 is a second immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cad-herin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH3 is a third immunoglobulin heavy chain vari-able region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; and L1, L2, L3, L4 and L5 are amino acid linkers. For the avoidance of doubt, all the antigen binding polypeptide structures described herein can be combined with any one or more of the targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VH1, VH2, and/or VH3 of each and every antigen binding polypeptide and antigen binding polypeptide complex described herein may independently bind to any one of said particularly preferred targets.

In some aspects, the antigen binding polypeptide complex comprises a first polypeptide and a second polypeptide; wherein the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; wherein the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1 is a first immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL2 is a second immunoglobu-lin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL3 is a third immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL4 is a fourth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL5 is a fifth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL6 is a sixth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGF-beta, GP100, GPRC5D, CD30 or CD16A; VH1 is a first immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, IL1A, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH2 is a second immuno-globulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, IL1A, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH3 is a third immunoglobulin heavy chain vari-able region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, IL1A, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH4 is a fourth immunoglobu-lin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH5 is a fifth immunoglobulin heavy chain vari-able region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH6 is a sixth immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; and L1, L2, L3, L4, L5, L6, L7, L8, L9 and L10 are amino acid linkers. In some aspects, the first polypeptide has a structure represented by VL1-VL2-VL3-VH3-VH2-VH1; and the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VL5-VH6-VL6-VL5-VL4; VL4-VH5-VH6-VL6-VL5-VH4; VH4-VH5-VL6-VH6-VL5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VH5-L10-VH4; VH4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VH1-VH2-VH3-VL3-VL2-VL1; and the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VH6-VL6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VH5-L10-VH4; VH4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VL1-VH2-VL3-VH3-VL2-VH1; and the second polypeptide has a structure represented by Fc; VL4-VH4;

VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VH6-VL6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VH5-L10-VH4; VH4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10- VL4. In some aspects, the first polypeptide has a structure represented by VH1-VL2-VH3-VL3-VH2-VL1; and the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VH6-VL6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VH5-L10-VH4; VH4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VL1-VL2-VH3-VL3-VH2-VH1; and the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VH6-VL6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VH5-L10-VH4; VH4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VH1-VH2-VL3-VH3-VL2-VL1; and the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VH6-VL6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VH5-L10-VH4; VH4-L6-VL5-L7-VH6-L8-VL6-L9-VH5-L10-VH4; VH4-L6-VH5-L7-VL6-L8-VH6-L9-VL5-L10-VL4;

VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VL1-VH2-VH3-VL3-VL2-VH1; and the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VH1-VL2-VL3-VH3-VH2-VL1; and the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VL1-L1-VL2-L2-VL3-L3-VH3-L4-VH2-L5-VH1; and the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; or VH4-L6-VL5-L7-VL6-L8-VH6-L9-VH5-L10-VL4. In some aspects, the first polypeptide has a structure represented by VH1-L1-VH2-L2-VH3-L3-VL3-L4-VL2-L5-VL1; and the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VH1-L1-VH2-L2-VH3-L3-VL3-L4-VL2-L5-VL1; and the second polypeptide has a structure represented by Fc; VL4-VH4; VH4-VL4; VL4-L6-VH4; VH4-L6-VL4; VL4-VL5-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-

VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VL1-L1-VH2-L2-VL3-L3-VH3-L4-VL2-L5-VH1; and the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; or VH4-L6-VL5-L7-VL6-L8-VH6-L9-VH5-L10-VL4. In some aspects, the first polypeptide has a structure represented by VH1-L1-VL2-L2-VH3-L3-VL3-L4-VH2-L5-VL1; and the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VL1-L1-VL2-L2-VH3-L3-VL3-L4-VH2-L5-VH1; and the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VH1-L1-VH2-L2-VL3-L3-VH3-L4-VL2-L5-VL1; and the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-

L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VL6-VL5-VH4; VH4-VL5-VH6-VL6-VH5-VL4; VL4-VL5-VH6-VL6-VH5-VH4; VH4-VH5-VL6-VH6-VL5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VL1-L1-VH2-L2-VH3-L3-VL3-L4-VL2-L5-VH1; and the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. In some aspects, the first polypeptide has a structure represented by VH1-L1-VL2-L2-VL3-L3-VH3-L4-VH2-L5-VL1; and the second polypeptide has a structure represented by Fc; VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VH6-VL6-VH5-VH4; VH4-VL5-VH6-VL6-VH5-VL4; VL4-VH5-VH6-VL6-VL5-VH4; VH4-VL5-VL6-VH6-VH5-VL4; VL4-VH5-VH6-VL6-VL5-VL4; VH4-VL5-VL6-VH6-VH5-VH4; VL4-VL5-VH6-VL6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4. The antigen binding polypeptide complex described herein may comprise any combination of VH1, VH2, VH3, VH4, VH5, VH6, VL1, VL2, VL3, VL4, VL5 and VL6 that each specifically bind to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, IL1A, IL1B, IL1F10, 112, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A. For the avoidance of doubt, all the antigen binding polypeptide structures described herein can be combined with any one or more of the targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VL4, VL5, VL6, VH1, VH2, VH3, VH4, VH5 and/or VH6 of each and every antigen binding polypeptide and antigen binding polypeptide complex described herein may independently bind to any one of said particularly preferred targets.

In some aspects, the antigen binding polypeptide or antigen binding polypeptide complex comprises a polypeptide having a structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; VH1-VL2-VL3-VH3-VH2-VL1-Fc; VL1-L1-VL2-L2-VL3-L3-VH3-L4-VH2-L5-VH1-Fc; VL1-L1-VL2-L2-VL3-L3-VH3-L4-VH2-L5-VH1-L6-Fc; VH1-L1-VH2-L2-VH3-L3-VL3-L4-VL2-L5-VL1-Fc; VH1-L1-VH2-L2-VH3-L3-VL3-L4-VL2-L5-VL1-L6-Fc; VL1-L1-VH2-L2-VL3-L3-VH3-L4-VL2-L5-VH1-Fc; VL1-L1-VH2-L2-VL3-L3-VH3-L4-VL2-L5-VH1-L6-Fc; VH1-L1-VL2-L2-VH3-L3-VL3-L4-VH2-L5-VL1-Fc; VH1-L1-VL2-L2-VH3-L3-VL3-L4-VH2-L5-VL1-L6-Fc; VL1-L1-VL2-L2-VH3-L3-VL3-L4-VL2-L5-VH1-Fc; VL1-L1-VL2-L2-VH3-L3-VL3-L4-VH2-L5-VH1-L6-Fc; VH1-L1-VH2-L2-VH3-L3-VL3-L4-VL2-L5-VL1-Fc; VH1-L1-VH2-L2-VL3-L3-VH3-L4-VL2-L5-VL1-Fc; VL1-L1-VH2-L2-VL3-L3-VH3-L4-VL2-L5-VL1-L6-Fc; VH1-L1-VL2-L2-VL3-L3-VH3-L4-VH2-L5-VH1-Fc; VL1-L1-VH2-L2-VL3-L3-VH3-L4-VL2-L5-VL1-Fc; VH1-L1-VL2-L2-VL3-L3-VH3-L4-VH2-L5-VL1-L6-Fc; VL1-L1-VH2-L2-VL3-L3-VH3-L4-VL2-L5-VH1-Fc; VL1-L1-VH2-L2-VL3-L3-VH3-L4-VL2-L5-VH1-L6-Fc; VH1-L1-VL2-L2-VL3-L3-VH3-L4-VH2-L5-VL1-Fc; or VH1-L1-VL2-L2-VL3-L3-VH3-L4-VH2-L5-VL1-L6-Fc; wherein VL1 is a first immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, IL1A, IL1B, IL1F10, IL2, IL4, IL4Ra, IL5, IL5R, IL6, IL7, IL7Ra, IL8, IL9, IL9R, IL10, rhIL1O, IL12, 1L13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL2 is a second immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL3 is a third immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH1 is a first immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TGFbeta, GP100, GPRC5D, CD30 or CD16A; VH2 is a second immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH3 is a third immunoglobulin heavy chain variable region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; Fc is a region comprising an immunoglobulin heavy chain constant region 2 (CH2), an immunoglobulin heavy chain constant region 3 (CH3), and optionally, an immunoglobulin hinge; and L1, L2, L3, L4, L5 and L6 are amino acid linkers. In some aspects, the antigen binding polypeptide has the structure VL1-VL2-VL3-VH3-VH2-VH1-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VH2-VH3-VL3-VL2-VL1-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-VH2-VL3-VH3-VL2-VH1-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VL2-VH3-VL3-VH2-VL1-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-VL2-VH3-VL3-VH2-VH1-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VH2-VL3-VH3-VL2-VL1-Fc; wherein VL1, VL2, VL3, VH1, VH2 and/or specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-VH2-VH3-VL3-VL2-VH1-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VL2-VL3-VH3-VH2-VL1-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VL3-L3-VH3-L4-VH2-L5-VH1-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cad-herin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGF-beta, GP100, GPRC5D, CD30 or CD16A. In some aspects, the antigen binding polypeptide has the structure VL1-L1-VL2-L2-VL3-L3-VH3-L4-VH2-L5-VH1-L6-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VH3-L3-VL3-L4-VL2-L5-VL1-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VH3-L3-VL3-L4-VL2-L5-VL1-L6-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VL3-L3-VH3-L4-VL2-L5-VH1-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VL3-L3-VH3-L4-VL2-L5-VH1-L6-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VH3-L3-VL3-L4-VH2-L5-VL1-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VH3-L3-VL3-L4-VH2-L5-VL1-L6-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VH3-L3-VL3-L4-VH2-L5-VH1-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VH3-L3-VL3-L4-VH2-L5-VH1-L6-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cad-herin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VL3-L3-VH3-L4-VL2-L5-VL1-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VL3-L3-VH3-L4-VL2-L5-VL1-L6-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VH3-L3-VL3-L4-VL2-L5-VH1-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VH3-L3-VL3-L4-VL2-L5-VH1-L6-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, 1118, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VL3-L3-VH3-L4-VH2-L5-VL1-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VL3-L3-VH3-L4-VH2-L5-VL1-L6-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For the avoidance of doubt, all the antigen binding polypeptide structures described herein can be combined with any one or more of the targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VH1, VH2, and/or VH3 of each and every antigen binding polypeptide and antigen binding polypeptide complex described herein may independently bind to any one of said particularly preferred targets.

In some aspects, the antigen binding polypeptide or antigen binding polypeptide complex comprises a polypeptide having a structure represented by VL1-VL2-VL3-VH3-VH2-VH1-Fc-Fc; VH1-VH2-VH3-VL3-VL2-VL1-Fc-Fc;

VL1-VH2-VL3-VH3-VL2-VH1-Fc-Fc; VH1-VL2-VH3-VL3-VH2-VL1-Fc-Fc; VL1-VL2-VH3-VL3-VH2-VH1-Fc-Fc; VH1-VH2-VL3-VH3-VL2-VL1-Fc-Fc; VL1-VH2-VH3-VL3-VL2-VH1-Fc-Fc; VH1-VL2-VL3-VH3-VH2-VL1-Fc-Fc; VH1-VL2-VL3-VH3-VH2-VL1-Fc-Fc; VL1-Fc-Fc; VL1-L1-VL2-L2-VL3-L3-VH3-L4-VH2-L5-VH1-Fc-Fc; VL1-L1-VL2-L2-VL3-L3-VH3-L4-VH2-L5-VH1-L6-Fc-Fc; VL1-L1-VL2-L2-VL3-L3-VH3-L4-VH2-L5-VH1-L6-Fc-L7-Fc; VH1-L1-VH2-L2-VH3-L3-VL3-L4-VL2-L5-VL1-Fc-Fc; VH1-L1-VH2-L2-VH3-L3-VL3-L4-VL2-L5-VL1-L6-Fc-Fc; VH1-L1-VH2-L2-VH3-L3-VL3-L4-VL2-L5-VL1-L6-Fc-L7-Fc; VL1-L1-VH2-L2-VL3-L3-VH3-L4-VL2-L5-VH1-Fc-Fc; VL1-L1-VH2-L2-VL3-L3-VH3-L4-VL2-L5-VH1-L6-Fc-Fc; VL1-L1-VH2-L2-VL3-L3-VH3-L4-VL2-L5-VH1-L6-Fc-L7-Fc; VH1-L1-VL2-L2-VH3-L3-VL3-L4-VH2-L5-VL1-Fc-Fc; VH1-L1-VL2-L2-VH3-L3-VL3-L4-VH2-L5-VL1-L6-Fc-Fc; VH1-L1-VL2-L2-VH3-L3-VL3-L4-VH2-L5-VL1-L6-Fc-L7-Fc; VL1-L1-VL2-L2-VH3-L3-VL3-L4-VH2-L5-VH1-Fc-Fc; VL1-L1-VL2-L2-VH3-L3-VL3-L4-VH2-L5-VH1-L6-Fc-Fc; VL1-L1-VL2-L2-VH3-L3-VL3-L4-VH2-L5-VH1-L6-Fc-L7-Fc; VH1-L1-VH2-L2-VL3-L3-VH3-L4-VL2-L5-VL1-Fc-Fc; VH1-L1-VH2-L2-VL3-L3-VH3-L4-VL2-L5-VL1-L6-Fc-Fc; VH1-L1-VH2-L2-VL3-L3-VH3-L4-VL2-L5-VL1-L6-Fc-L7-Fc; L1-L1-VH2-L2-VH3-L3-VL3-L4-VL2-L5-VH1-Fc-Fc; VL1-L1-VH2-L2-VH3-L3-VL3-L4-VL2-L5-VH1-L6-Fc-Fc; VL1-L1-VH2-L2-VH3-L3-VL3-L4-VL2-L5-VH1-L6-Fc-L7-Fc; VH1-L1-VL2-L2-VL3-L3-VH3-L4-VH2-L5-VL1-Fc-Fc; VH1-L1-VL2-L2-VL3-L3-VH3-L4-VH2-L5-VL1-L6-Fc-Fc; or VH1-L1-VL2-L2-VL3-L3-VH3-L4-VH2-L5-VL1-L6-Fc-L7-Fc; wherein VL1 is a first immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL2 is a second immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL3 is a third immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH1 is a first immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGF-beta, GP100, GPRC5D, CD30 or CD16A; VH2 is a second immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH3 is a third immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cad-herin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; Fc is a region comprising an immunoglobulin heavy chain constant region 2 (CH2), an immunoglobulin heavy chain constant region 3 (CH3), and optionally, an immunoglobulin hinge; and L1, L2, L3, L4, L5, L6 and L7 are amino acid linkers. In some aspects, the antigen binding polypeptide has the structure VL1-VL2-VL3-VH3-VH2-

VH1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VH2-VH3-VL3-VL2-VL1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-VH2-VL3-VH3-VL2-VH1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VL2-VH3-VL3-VH2-VL1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-VL2-VH3-VL3-VH2-VH1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VH2-VL3-VH3-VL2-VL1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-VH2-VH3-VL3-VL2-VH1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VL2-VL3-VH3-VH2-VL1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VL3-L3-VH3-L4-VH2-L5-VH1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VL3-L3-VH3-L4-VH2-L5-VH1-L6-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, 1118, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VL3-L3-VH3-L4-VH2-L5-VH1-L6-Fc-L7-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VH3-L3-VL3-L4-VL2-L5-VL1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VH3-L3-VL3-L4-VL2-L5-VL1-L6-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VH3-L3-VL3-L4-VL2-L5-VL1-L6-Fc-L7-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VL3-L3-VH3-L4-VL2-L5-VH1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VL3-L3-VH3-L4-VL2-L5-VH1-L6-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VL3-L3-VH3-L4-VL2-L5-VH1-L6-Fc-L7-Fc;      wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VH3-L3-VL3-L4-VH2-L5-VL1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VH3-L3-VL3-L4-VH2-L5-VL1-L6-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VH3-L3-VL3-L4-VH2-L5-VL1-L6-Fc-L7-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VH3-L3-VL3-L4-VH2-L5-VH1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VH3-L3-VL3-L4-VH2-L5-VH1-L6-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VH3-L3-VL3-L4-VH2-L5-VH1-L6-Fc-L7-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VL3-L3-VH3-L4-VL2-L5-VL1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VL3-L3-VH3-L4-VL2-L5-VL1-L6-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VL3-L3-VH3-L4-VL2-L5-VL1-L6-Fc-L7-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure L1-L1-VH2-L2-VH3-L3-VL3-L4-VL2-L5-VH1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VIA-L1-VH2-L2-VH3-L3-VL3-L4-VL2-L5-VH1-L6-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VH3-L3-VL3-L4-VL2-L5-VH1-L6-Fc-L7-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VL3-L3-VH3-L4-VH2-L5-VL1-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase- 1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VL3-L3-VH3-L4-VH2-L5-VL1-L6-Fc-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VL3-L3-VH3-L4-VH2-L5-VL1-L6-Fc-L7-Fc; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For the avoidance of doubt, all the antigen binding polypeptide structures described herein can be combined with any one or more of the targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VH1, VH2, and/or VH3 of each and every antigen binding polypeptide and antigen binding polypeptide complex described herein may independently bind to any one of said particularly preferred targets.

In some aspects, an antigen binding polypeptide complex of the invention comprises a first polypeptide and a second polypeptide, wherein the first polypeptide has a structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; VH1-VL2-VL3-VH3-VH2-VL1-Fc; VL1-L1-VL2-L2-VL3-L3-VH3-L4-VH2-L5-VH1-Fc; VL1-L1-VL2-L2-VL3-L3-VH3-L4-VH2-L5-VH1-L6-Fc; VH1-L1-VH2-L2-VH3-L3-VL3-L4-VL2-L5-VL1-Fc; VH1-L1-VH2-L2-VH3-L3-VL3-L4-VL2-L5-VL1-L6-Fc; VL1-L1-VL2-L2-VL3-L3-VH3-L4-VL2-L5-VH1-Fc; VL1-L1-VL2-L2-VH3-L3-VL3-L4-VL2-L5-VH1-L6-Fc; VH1-L1-VL2-L2-VH3-L3-VL3-L4-VH2-L5-VL1-Fc; VH1-L1-VL2-L2-VH3-L3-VL3-L4-VH2-L5-VL1-L6-Fc; VL1-L1-VL2-L2-VH3-L3-VL3-L4-VH2-L5-VH1-Fc; VH1-L1-VL2-L2-VL3-L3-VH3-L4-VH2-L5-VH1-L6-Fc; VH1-L1-VH2-L2-VL3-L3-VH3-L4-VL2-L5-VL1-Fc; VH1-L1-VH2-L2-VL3-L3-VH3-L4-VL2-L5-VL1-L6-Fc; VL1-L1-VH2-L2-VH3-L3-VL3-L4-VL2-L5-VH1-Fc; VL1-L1-VH2-L2-VH3-L3-VL3-L4-VL2-L5-VH1-L6-Fc; VH1-L1-VL2-L2-VL3-L3-VH3-L4-VH2-L5-VL1-Fc; or VH1-L1-VL2-L2-VL3-L3-VH3-L4-VH2-L5-VL1-L6-Fc; wherein the second polypeptide has a structure represented by Fc; VL4-VH4-Fc; VH4-VL4-Fc; VL4-L7-VH4-Fc; VL4-L7-VH4-L8-Fc; VH4-L7-VL4-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-

L10-VL5-L11-VH4-L12-Fc; or VH4-L7-VL5-L8-VL6-L9-VH6-L10-VH5-L11-VL4-L12-Fc; wherein VL1 is a first immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL2 is a second immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL3 is a third immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL4 is a fourth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL5 is a fifth immunoglobulin light chain variable region that specifically binds A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL6 is a sixth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH1 is a first immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH2 is a second immuno-globulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH3 is a third immunoglobulin heavy chain variable region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH4 is a fourth immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH5 is a fifth immunoglobulin heavy chain variable region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH6 is a sixth immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cad-herin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, Ill, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGF-beta, GP100, GPRC5D, CD30 or CD16A; Fc is a region comprising an immunoglobulin heavy chain constant region 2 (CH2), an immunoglobulin heavy chain constant region 3 (CH3), and optionally, an immunoglobulin hinge; CH1 is a heavy chain constant region 1; CL is a light chain constant region; and L1, L2, L3, L4, L5, L6, L7, L8, L9, L10 and L11 are amino acid linkers. For the avoidance of doubt, all the antigen binding polypeptide structures described herein can be combined with any one or more of the targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VL4, VL5, VL6, VH1, VH2, VH3, VH4, VH5 and/or VH6 of each and every antigen binding polypeptide and antigen binding polypeptide complex described herein may independently bind to any one of said particularly preferred targets.

In some aspects, the antigen binding polypeptide has a structure represented by VL1-VL2-VL3-VH3-VH2-VH1-CH1-CL; VL1-VL2-VL3-VH3-VH2-VH1-CL-CH1; VH1-VH2-VH3-VL3-VL2-VL1-CH1-CL; VH1-VH2-VH3-VL3-VL2-VL1-CL-CH1; VL1-VH2-VL3-VH3-VL2-VH1-CH1-CL; VL1-VH2-VL3-VH3-VL2-VH1-CL-CH1; VH1-VL2-VH3-VL3-VH2-VL1-CH1-CL; VH1-VL2-VH3-VL3-VH2-VL1-CL-CH1; VL1-VL2-VH3-VL3-VH2-VH1-CH1-CL; VL1-VL2-VH3-VL3-VH2-VH1-CL-CH1; VH1-VH2-VL3-VH3-VL2-VL1-CH1-CL; VH1-VH2-VL3-VH3-VL2-VL1-CL-CH1; VL1-VH2-VH3-VL3-VL2-VH1-CH1-CL; VL1-VH2-VH3-VL3-VL2-VH1-CL-CH1; VH1-VL2-VL3-VH3-VH2-VL1-CH1-CL; VH1-VL2-VL3-VH3-VH2-VL1-CL-CH1; VL1-L1-VL2-L2-VL3-L3-VH3-L4-VH2-L5-VH1-CH1-CL; VL1-L1-VL2-L2-VL3-L3-VH3-L4-VH2-L5-VH1-L6-CH1-CL; VL1-L1-VL2-L2-VL3-L3-VH3-L4-VH2-L5-VH1-L6-CH1-L7-CL; VL1-L1-VL2-L2-VL3-L3-VH3-L4-VH2-L5-VH1-CL-CH1; VL1-L1-VL2-L2-VL3-L3-VH3-L4-VH2-L5-VH1-L6-CL-CH1; VL1-L1-VL2-L2-VL3-L3-VH3-L4-VH2-L5-VH1-L6-CL-L7-CH1; VH1-L1-VH2-L2-VH3-L3-VL3-L4-VL2-L5-VL1-CH1-CL; VH1-L1-VH2-L2-VH3-L3-VL3-L4-VL2-L5-VL1-L6-CH1-CL; VH1-L1-VH2-L2-VH3-L3-VL3-L4-VL2-L5-VL1-L6-CH1-L7-CL; VH1-L1-VH2-L2-VH3-L3-VL3-L4-VL2-L5-VL1-CL-CH1; VH1-L1-VH2-L2-VH3-L3-VL3-L4-VL2-L5-VL1-L6-CL-CH1; VH1-L1-VH2-L2-VH3-L3-VL3-L4-VL2-L5-VL1-L6-CL-L7-CH1; VL1-L1-VH2-L2-VL3-L3-VH3-L4-VL2-L5-VH1-CH1-CL; VL1-L1-VH2-L2-VL3-L3-VH3-L4-VL2-L5-VH1-L6-CH1-CL; VL1-L1-VH2-L2-VL3-L3-VH3-L4-VL2-L5-VH1-L6-CH1-L7-CL; VL1-L1-VH2-L2-VL3-L3-VH3-L4-VL2-L5-VH1-CL-CH1; VL1-L1-VH2-L2-VL3-L3-VH3-L4-VL2-L5-VH1-L6-CL-CH1; VL1-L1-VH2-L2-VL3-L3-VH3-L4-VL2-L5-VH1-L6-CL-L7-CH1; VH1-L1-VL2-L2-VH3-L3-VL3-L4-VH2-L5-VL1-CH1-CL; VH1-L1-VL2-L2-VH3-L3-VL3-L4-VH2-L5-VL1-L6-CH1-CL; VH1-L1-VL2-L2-VH3-L3-VL3-L4-VH2-L5-VL1-L6-CH1-L7-CL; VH1-L1-VL2-L2-VH3-L3-VL3-L4-VH2-L5-VL1-CL-CH1; VH1-L1-VL2-L2-VH3-L3-VL3-L4-VH2-L5-VL1-L6-CL-CH1; VH1-L1-VL2-L2-VH3-L3-VL3-L4-VH2-L5-VL1-L6-CL-L7-CH1; VL1-L1-VH2-L2-VH3-L3-VL3-L4-VL2-L5-VH1-CH1-CL; VL1-L1-VH2-L2-VH3-L3-VL3-L4-VL2-L5-VH1-L6-CH1-CL; VL1-L1-VH2-L2-VH3-L3-VL3-L4-VL2-L5-VH1-L6-CH1-L7-CL; VL1-L1-VH2-L2-VH3-L3-VL3-L4-VL2-L5-VH1-CL-CH1; VL1-L1-VH2-L2-VH3-L3-VL3-L4-VL2-L5-VH1-L6-CL-CH1; VL1-L1-VH2-L2-VH3-L3-VL3-L4-VL2-L5-VH1-L6-CL-L7-CH1; VL1-L1-VH2-L2-VH3-L3-VL3-L4-VL2-L5-VH1-L6-CH1-L7-CL; VL1-L1-VH2-L2-VH3-L3-VL3-L4-VL2-L5-VH1-L6-CH1-L7-CL; VL1-L1-VH2-L2-VH3-L3-VL3-L4-VL2-L5-VH1-CL-CH1; VL1-L1-VH2-L2-VH3-L3-VL3-L4-VL2-L5-VH1-L6-CL-CH1; VL1-L1-VH2-L2-VH3-L3-

VL3-L4-VL2-L5-VH1-L6-CH1-L7-CL; VL1-L1-VH2-L2-VH3-L3-VL3-L4-VL2-L5-VH1-CL-CH1; VL1-L1-VH2-L2-VH3-L3-VL3-L4-VL2-L5-VH1-L6-CL-CH1; VL1-L1-VH2-L2-VH3-L3-VL3-L4-VL2-L5-VH1-L6-CL-L7-CH1; VH1-L1-VL2-L2-VL3-L3-VH3-L4-VH2-L5-VL1-CH1-CL; VH1-L1-VL2-L2-VL3-L3-VH3-L4-VH2-L5-VL1-L6-CH1-CL; VH1-L1-VL2-L2-VL3-L3-VH3-L4-VH2-L5-VL1-L6-CH1-L7-CL; VH1-L1-VL2-L2-VL3-L3-VH3-L4-VH2-L5-VL1-CL-CH1; VH1-L1-VL2-L2-VL3-L3-VH3-L4-VH2-L5-VL1-L6-CL- CH1; or VH1-L1-VL2-L2-VL3-L3-VH3-L4-VH2-L5-VL1-L6-CL-L7-CH1; wherein VL1 is a first immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, 1L13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL2 is a second immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL3 is a third immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH1 is a first immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH2 is a second immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH3 is a third immunoglobulin heavy chain variable region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; CH1 is a heavy chain constant region 1; CL is a light chain constant region; and L1, L2, L3, L4, L5, L6 and L7 are amino acid linkers. In some aspects, the antigen binding polypeptide has the structure VL1-VL2-VL3-VH3-VH2-VH1-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cad-herin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-VL2-VL3-VH3-VH2-VH1-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VH2-VH3-VL3-VL2-VL1-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, 1118, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VH2-VH3-VL3-

VL2-VL1-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-VH2-VL3-VH3-VL2-VH1-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-VH2-VL3-VH3-VL2-VH1-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VL2-VH3-VL3-VH2-VL1-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VL2-VH3-VL3-VH2-VL1-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-VL2-VH3-VL3-VH2-VH1-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-VL2-VH3-VL3-VH2-VH1-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, 1110, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VH2-VL3-VH3-VL2-VL1-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VH2-VL3-VH3-VL2-VL1-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-VH2-VH3-VL3-VL2-VH1-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-VH2-VH3-VL3-VL2-VH1-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VL2-VL3-VH3-VH2-VL1-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-VL2-VL3-VH3-VH2-VL1-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VIA-L1-VL2-L2-VL3-L3-VH3-L4-VH2-L5-VH1-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, 5152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VL3-L3-VH3-L4-VH2-L5-VH1-L6-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VL3-L3-VH3-L4-VH2-L5-VH1-L6-CH1-L7-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, 5152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VL3-L3-VH3-L4-VH2-L5-VH1-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VL3-L3-VH3-L4-VH2-L5-VH1-L6-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VL3-L3-VH3-L4-VH2-L5-VH1-L6-CL-L7-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VH3-L3-VL3-L4-VL2-L5-VL1-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VH3-L3-VL3-L4-VL2-L5-VL1-L6-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VH3-L3-VL3-L4-VL2-L5-VL1-L6-CH1-L7-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VH3-L3-VL3-L4-VL2-L5-VL1-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, 5152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VH3-L3-VL3-L4-VL2-L5-VL1-L6-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VH3-L3-VL3-L4-VL2-L5-VL1-L6-CL-L7-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VL3-L3-VH3-L4-VL2-L5-VH1-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VL3-L3-VH3-L4-VL2-L5-VH1-L6-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VL3-L3-VH3-L4-VL2-L5-VH1-L6-CH1-L7-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VL3-L3-VH3-L4-VL2-L5-VH1-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VL3-L3-VH3-L4-VL2-L5-VH1-L6-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VIA-L1-VH2-L2-VL3-L3-VH3-L4-VL2-L5-VH1-L6-CL-L7-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VH3-L3-VL3-L4-VH2-L5-VL1-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, 5152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VH3-L3-VL3-L4-VH2-L5-VL1-L6-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VH3-L3-VL3-L4-VH2-L5-VL1-L6-CH1-L7-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, 5152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VH3-L3-VL3-L4-VH2-L5-VL1-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VH3-L3-VL3-L4-VH2-L5-VL1-L6-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VH3-L3-VL3-L4-VH2-L5-VL1-L6-CL-L7-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cad-herin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VH3-L3-VL3-L4-VH2-L5-VH1-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VH3-L3-VL3-L4-VH2-L5-VH1-L6-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VH3-L3-VL3-L4-VH2-L5-VH1-L6-CH1-L7-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VIA-L1-VL2-L2-VH3-L3-VL3-L4-VH2-L5-VH1-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, 5152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VH3-L3-VL3-L4-VH2-L5-VH1-L6-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VL2-L2-VH3-L3-VL3-L4-VH2-L5-VH1-L6-CL-L7-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, 5152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VL3-L3-VH3-L4-VL2-L5-VL1-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VL3-L3-VH3-L4-VL2-L5-VL1-L6-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VL3-L3-VH3-L4-VL2-L5-VL1-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VL3-L3-VH3-L4-VL2-L5-VL1-L6-CL-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VH2-L2-VL3-L3-VH3-L4-VL2-L5-VL1-L6-CL-L7-CH1; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VIA-L1-VH2-L2-VH3-L3-VL3-L4-VL2-L5-VH1-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VH3-L3-VL3-L4-VL2-L5-VH1-L6-CH1-CL; wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VH3-L3-VL3-L4-VL2-L5-VH1-L6-CH1-L7-CL, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, 5152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VH3-L3-VL3-L4-VL2-L5-VH1-L6-CL-CH1, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VL1-L1-VH2-L2-VH3-L3-VL3-L4-VL2-L5-VH1-L6-CL-L7-CH1, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, 5152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VL3-L3-VH3-L4-VH2-L5-VL1-CH1-CL, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VL3-L3-VH3-L4-VH2-L5-VL1-L6-CH1-CL, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VL3-L3-VH3-L4-VH2-L5-VL1-L6-CH1-L7-CL, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VL3-L3-VH3-L4-VH2-L5-VL1-CL-CH1, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VL3-L3-VH3-L4-VH2-L5-VL1-L6-CL-CH1, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure VH1-L1-VL2-L2-VL3-L3-VH3-L4-VH2-L5-VL1-L6-CL-L7-CH1, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For the avoidance of doubt, all the antigen binding polypeptide structures described herein can be combined with any one or more of the targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VH1, VH2, and/or VH3 of each and every antigen binding polypeptide and antigen binding polypeptide complex described herein may independently bind to any one of said particularly preferred targets.

In some aspects, the antigen binding polypeptide complex comprises a first polypeptide and a second polypeptide; wherein the first polypeptide has a structure represented by VL1-VL2-VL3-VH3-VH2-VH1-CH1; VL1-VL2-VL3-VH3-VH2-VH1-CL; VL1-VL2-VL3-VH3-VH2-VH1-CH1-CL; VL1-VL2-VL3-VH3-VH2-VH1-CL-CH1; VH1-VH2-VH3-VL3-VL2-VL1-CH1; VH1-VH2-VH3-VL3-VL2-VL1-CL; VH1-VH2-VH3-VL3-VL2-VL1-CH1-CL; VH1-VH2-VH3-VL3-VL2-VL1-CL-CH1; VL1-VH2-VL3-VH3-VL2-VH1-CH1; VL1-VH2-VL3-VH3-VL2-VH1-CL; VL1-VH2-VL3-VH3-VL2-VH1-CH1-CL; VL1-VH2-VL3-VH3-VL2-VH1-CL-CH1; VH1-VL2-VH3-VL3-VH2-VL1-CH1; VH1-VL2-VH3-VL3-VH2-VL1-CL; VH1-VL2-VH3-VL3-VH2-VL1-CH1-CL; VH1-VL2-VH3-VL3-VH2-VL1-CL-CH1; VL1-VL2-VH3-VL3-VH2-VH1-CH1; VL1-VL2-VH3-VL3-VH2-VH1-CL; VL1-VL2-VH3-VL3-VH2-VH1-CH1-CL; VL1-VL2-VH3-VL3-VH2-VH1-CL-CH1; VH1-VH2-VL3-VH3-VL2-VL1-CH1; VH1-VH2-VL3-VH3-VL2-VL1-CL; VH1-VH2-VL3-VH3-VL2-VL1-CH1-CL; VH1-VH2-VL3-VH3-VL2-VL1-CL-CH1; VL1-VH2-VH3-VL3-VL2-VH1-CH1; VL1-VH2-VH3-VL3-VL2-VH1-CL; VL1-VH2-VH3-VL3-VL2-VH1-CH1-CL; VL1-VH2-VH3-VL3-VL2-VH1-CL-CH1; VH1-VL2-VL3-VH3-VH2-VL1-CH1; VH1-VL2-VL3-VH3-VH2-VL1-CL; VH1-VL2-VL3-VH3-VH2-VL1-CH1-CL; VH1-VL2-VL3-VH3-VH2-VL1-CL-CH1; VL1-L1-VL2-L2-VL3-L3-VH3-L4-VH2-L5-VH1-CH1; VL1-L1-VL2-L2-VL3-L3-VH3-L4-VH2-L5-VH1-L6-CH1; VL1-L1-VL2-L2-VL3-L3-VH3-L4-VH2-L5-VH1-CL; VL1-L1-VL2-L2-VL3-L3-VH3-L4-VH2-L5-VH1-L6-CL; VL1-L1-VL2-L2-VL3-L3-

VH3-L4-VH2-L5-VH1-CH1-CL; VL1-L1-VL2-L2-VL3-L3-VH3-L4-VH2-L5-VH1-L6-CH1-CL; VL1-L1-VL2-L2-VL3-L3-VH3-L4-VH2-L5-VH1-L6-CH1-L7-CL; VL1-L1-VL2-L2-VL3-L3-VH3-L4-VH2-L5-VH1-CL-CH1; VL1-L1-VL2-L2-VL3-L3-VH3-L4-VH2-L5-VH1-L6-CL-CH1; VL1-L1-VL2-L2-VL3-L3-VH3-L4-VH2-L5-VH1-L6-CL-L7-CH1; VH1-L1-VH2-L2-VH3-L3-VL3-L4-VL2-L5-VL1-CH1; VH1-L1-VH2-L2-VH3-L3-VL3-L4-VL2-L5-VL1-L6-CH1; VH1-L1-VH2-L2-VH3-L3-VL3-L4-VL2-L5-VL1-CL; VH1-L1-VH2-L2-VH3-L3-VL3-L4-VL2-L5-VL1-L6-CL; VH1-L1-VH2-L2-VH3-L3-VL3-L4-VL2-L5-VL1-CH1-CL; VH1-L1-VH2-L2-VH3-L3-VL3-L4-VL2-L5-VL1-L6-CH1-CL; VH1-L1-VH2-L2-VH3-L3-VL3-L4-VL2-L5-VL1-L6-CH1-L7-CL; VH1-L1-VH2-L2-VH3-L3-VL3-L4-VL2-L5-VL1-CL-CH1; VH1-L1-VH2-L2-VH3-L3-VL3-L4-VL2-L5-VL1-L6-CL-CH1; VH1-L1-VH2-L2-VH3-L3-VL3-L4-VL2-L5-VL1-L6-CL-L7-CH1; VL1-L1-VH2-L2-VL3-L3-VH3-L4-VL2-L5-VH1-CH1; VL1-L1-VH2-L2-VL3-L3-VH3-L4-VL2-L5-VH1-L6-CH1; VL1-L1-VH2-L2-VL3-L3-VH3-L4-VL2-L5-VH1-CL; VL1-L1-VH2-L2-VL3-L3-VH3-L4-VL2-L5-VH1-L6-CL; VL1-L1-VH2-L2-VL3-L3-VH3-L4-VL2-L5-VH1-CH1-CL; VL1-L1-VH2-L2-VL3-L3-VH3-L4-VL2-L5-VH1-L6-CH1-CL; VL1-L1-VH2-L2-VL3-L3-VH3-L4-VL2-L5-VH1-L6-CH1-L7-CL; VL1-L1-VH2-L2-VL3-L3-VH3-L4-VL2-L5-VH1-CL-CH1; VL1-L1-VH2-L2-VL3-L3-VH3-L4-VL2-L5-VH1-L6-CL-CH1; VL1-L1-VH2-L2-VL3-L3-VH3-L4-VL2-L5-VH1-L6-CL-L7-CH1; VH1-L1-VL2-L2-VH3-L3-VL3-L4-VH2-L5-VL1-CH1; VH1-L1-VL2-L2-VH3-L3-VL3-L4-VH2-L5-VL1-L6-CH1; VH1-L1-VL2-L2-VH3-L3-VL3-L4-VH2-L5-VL1-CL; VH1-L1-VL2-L2-VH3-L3-VL3-L4-VH2-L5-VL1-L6-CL; VH1-L1-VL2-L2-VH3-L3-VL3-L4-VH2-L5-VL1-CH1-CL; VH1-L1-VL2-L2-VH3-L3-VL3-L4-VH2-L5-VL1-L6-CH1-CL; VH1-L1-VL2-L2-VH3-L3-VL3-L4-VH2-L5-VL1-L6-CH1-L7-CL; VH1-L1-VL2-L2-VH3-L3-VL3-L4-VH2-L5-VL1-CL-CH1; VH1-L1-VL2-L2-VH3-L3-VL3-L4-VH2-L5-VL1-L6-CL-CH1; VH1-L1-VL2-L2-VH3-L3-VL3-L4-VH2-L5-VL1-L6-CL-L7-CH1; VL1-L1-VL2-L2-VH3-L3-VL3-L4-VH2-L5-VH1-CH1; VL1-L1-VL2-L2-VH3-L3-VL3-L4-VH2-L5-VH1-L6-CH1; VL1-L1-VL2-L2-VH3-L3-VL3-L4-VH2-L5-VH1-CL; VL1-L1-VL2-L2-VH3-L3-VL3-L4-VH2-L5-VH1-L6-CL; VL1-L1-VL2-L2-VH3-L3-VL3-L4-VH2-L5-VH1-CH1-CL; VL1-L1-VL2-L2-VH3-L3-VL3-L4-VH2-L5-VH1-L6-CH1-CL; VL1-L1-VL2-L2-VH3-L3-VL3-L4-VH2-L5-VH1-L6-CH1-L7-CL; VL1-L1-VL2-L2-VH3-L3-VL3-L4-VH2-L5-VH1-CL-CH1; VL1-L1-VL2-L2-VH3-L3-VL3-L4-VH2-L5-VH1-L6-CL-CH1; VL1-L1-VL2-L2-VH3-L3-VL3-L4-VH2-L5-VH1-L6-CL-L7-CH1; VH1-L1-VL2-L2-VH3-L3-VL3-L4-VH2-L5-VL1-CH1; VH1-L1-VL2-L2-VH3-L3-VL3-L4-VH2-L5-VL1-L6-CH1; VH1-L1-VL2-L2-VH3-L3-VH3-L4-VL2-L5-VL1-CL; VH1-L1-VL2-L2-VH3-L3-VH3-L4-VL2-L5-VL1-L6-CL; VH1-L1-VL2-L2-VH3-L3-VH3-L4-VL2-L5-VL1-CH1-CL; VH1-L1-VL2-L2-VH3-L3-VH3-L4-VL2-L5-VL1-L6-CH1-CL; VH1-L1-VH2-L2-VL3-L3-VH3-L4-VL2-L5-VL1-CH1; VH1-L1-VH2-L2-VL3-L3-VH3-L4-VL2-L5-VL1-L6-CH1; VH1-L1-VH2-L2-VL3-L3-VH3-L4-VL2-L5-VL1-CL; VH1-L1-VH2-L2-VL3-L3-VH3-L4-VL2-L5-VL1-L6-CL; VH1-L1-VH2-L2-VL3-L3-VH3-L4-VL2-L5-VL1-CH1-CL; VH1-L1-VH2-L2-VL3-L3-VH3-L4-VL2-L5-VL1-L6-CH1-CL; VH1-L1-VH2-L2-VL3-L3-VH3-L4-VL2-L5-VL1-L6-CH1-L7-CL; VL1-L1-VH2-L2-VL3-L3-VH3-L4-VL2-L5-VH1-CH1; VL1-L1-VH2-L2-VL3-L3-VH3-L4-VL2-L5-VH1-L6-CH1; VL1-L1-VH2-L2-VH3-L3-VL3-L4-VL2-L5-VH1-CL; VL1-L1-VH2-L2-VH3-L3-VL3-L4-VL2-L5-VH1-L6-CL; VL1-L1-VH2-L2-VH3-L3-VL3-L4-VL2-L5-VH1-CH1-CL; VL1-L1-VH2-L2-VH3-L3-VL3-L4-VL2-L5-VH1-L6-CH1-CL; VL1-L1-VH2-L2-VH3-L3-VL3-L4-VL2-L5-VH1-L6-CH1-L7-CL; VL1-L1-

VH2-L2-VH3-L3-VL3-L4-VL2-L5-VH1-CL- CH1; VL1-L1-VH2-L2-VH3-L3-VL3-L4-VL2-L5-VH1-L6-CL-CH1; VL1-L1-VH2-L2-VH3-L3-VL3-L4-VL2-L5-VH1-L6-CL-L7-CH1; VH1-L1-VL2-L2-VL3-L3-VH3-L4-VH2-L5-VL1-CH1; VH1-L1-VL2-L2-VL3-L3-VH3-L4-VH2-L5-VL1-L6-CH1; VH1-L1-VL2-L2-VL3-L3-VH3-L4-VH2-L5-VL1-CL; VH1-L1-VL2-L2-VL3-L3-VH3-L4-VH2-L5-VL1-L6-CL; VH1-L1-VL2-L2-VL3-L3-VH3-L4-VH2-L5-VL1-CH1-CL; VH1-L1-VL2-L2-VL3-L3-VH3-L4-VH2-L5-VL1-L6-CH1-CL; VH1-L1-VL2-L2-VL3-L3-VH3-L4-VH2-L5-VL1-L6-CH1-L7-CL; VH1-L1-VL2-L2-VL3-L3-VH3-L4-VH2-L5-VL1-CL-CH1; VH1-L1-VL2-L2-VL3-L3-VH3-L4-VH2-L5-VL1-L6-CL-CH1; or VH1-L1-VL2-L2-VL3-L3-VH3-L4-VH2-L5-VL1-L6-CL-L7-CH1;

wherein the second polypeptide has a structure represented by VL4-VH4-CH1; VL4-VH4-CL; VL4-VH4-CH1-CL; VL4-VH4-CL-CH1; VH4-VL4-CH1; VH4-VL4-CL; VH4-VL4-CH1-CL; VH4-VL4-CL-CH1; VL4-L8-VH4-CH1; VL4-L8-VH4-CL; VL4-L8-VH4-CH1-CL; VL4-L8-VH4-CL-CH1; VH4-L8-VL4-CH1; VH4-L8-VL4-CL; VH4-L8-VH4-CH1-CL; VH4-L8-VH4-CL-CH1; VL4-VL5-VH5-VH4-CH1; VL4-VL5-VH5-VH4-CL; VL4-VL5-VH5-VH4-CH1-CL; VL4-VL5-VH5-VH4-CL-CH1; VH4-VH5-VL5-VL4-CH1; VH4-VH5-VL5-VL4-CL; VH4-VH5-VL5-VL4-CH1-CL; VH4-VH5-VL5-VL4-CL-CH1; VL4-L8-VL5-L9-VH5-L10-VH4-CH1; VL4-L8-VL5-L9-VH5-L10-VH4-CL; VL4-L8-VL5-L9-VH5-L10-VH4-CH1-CL; VL4-L8-VL5-L9-VH5-L10-VH4-CL-CH1; VH4-L8-VH5-L9-VL5-L10-VL4-CH1; VH4-L8-VH5-L9-VL5-L10-VL4-CL; VH4-L8-VH5-L9-VL5-L10-VL4-CH1-CL; VH4-L8-VH5-L9-VL5-L10-VL4-CL-CH1; VL4-VL5-VL6-VH6-VH5-VH4-CH1; VL4-VL5-VL6-VH6-VH5-VH4-CL; VL4-VL5-VL6-VH6-VH5-VH4-CH1-CL; VL4-VL5-VL6-VH6-VH5-VH4-CL-CH1; VH4-VH5-VH6-VL6-VL5-VL4-CH1; VH4-VH5-VH6-VL6-VL5-VL4-CL; VH4-VH5-VH6-VL6-VL5-VL4-CH1-CL; VH4-VH5-VH6-VL6-VL5-VL4-CL-CH1; VL4-VH5-VL6-VH6-VL5-VH4-CH1; VL4-VH5-VL6-VH6-VL5-VH4-CL; VL4-VH5-VL6-VH6-VL5-VH4-CH1-CL; VL4-VH5-VL6-VH6-VL5-VH4-CL-CH1; VH4-VL5-VH6-VL6-VH5-VL4-CH1; VH4-VL5-VH6-VL6-VH5-VL4-CL; VH4-VL5-VH6-VL6-VH5-VL4-CH1-CL; VH4-VL5-VH6-VL6-VH5-VL4-CL-CH1; VL4-VL5-VH6-VL6-VH5-VH4-CH1; VL4-VL5-VH6-VL6-VH5-VH4-CL; VL4-VL5-VH6-VL6-VH5-VH4-CH1-CL; VL4-VL5-VH6-VL6-VH5-VH4-CL-CH1; VH4-VH5-VL6-VH6-VL5-VL4-CH1; VH4-VH5-VL6-VH6-VL5-VL4-CL; VH4-VH5-VL6-VH6-VL5-VL4-CH1-CL; VH4-VH5-VL6-VH6-VL5-VL4-CL-CH1; VL4-VH5-VL6-VH6-VL5-VH4-CH1; VL4-VH5-VH6-VL6-VL5-VH4-CL; VL4-VH5-VH6-VL6-VL5-VH4-CH1-CL; VL4-HS-VH6-VL6-VL5-VH4-CL-CH1; VL4-VH5-VL6-VH6-VH5-VL4-CH1; VH4-VL5-VL6-VH6-VH5-VL4-CL; VH4-VL5-VL6-VH6-VH5-VL4-CH1-CL; VH4-VL5-VL6-VH6-VH5-VL4-CL-CH1; VL4-L8-VL5-L9-VL6-L10-VH6-L11-VH5-L12-VH4-CH1; VL4-L8-VL5-L9-VL6-L10-VH6-L11-VH5-L12-VH4-CL; VL4-L8-VL5-L9-VL6-L10-VH6-L11-VH5-L12-VH4-CH1-CL; VL4-L8-VL5-L9-VL6-L10-VH6-L11-VH5-L12-VH4-CL-CH1; VH4-L8-VH5-L9-VH6-L10-VL6-L11-VL5-L12-VL4-CH1; VH4-L8-VH5-L9-VH6-L10-VL6-L11-VL5-L12-VL4-CL; VH4-L8-VH5-L9-VH6-L10-VL6-L11-VL5-L12-VL4-CH1-CL; VH4-L8-VH5-L9-VH6-L10-VL6-L11-VL5-L12-VL4-CL-CH1; VL4-L8-VH5-L9-VL6-L10-VH6-L11-VL5-L12-VH4-CH1; VL4-L8-VH5-L9-VL6-L10-VH6-L11-VL5-L12-VH4-CL; VL4-L8-VH5-L9-VL6-L10-VH6-L11-VL5-L12-VH4-CH1-CL; VL4-L8-VH5-L9-VL6-L10-VH6-L11-VL5-L12-VH4-CL-CH1; VH4-L8-VL5-L9-VH6-L10-

VL6-L11-VH5-L12-VL4-CH1; VH4-L8-VL5-L9-VH6-L10-VL6-L11-VH5-L12-VL4-CL; VH4-L8-VL5-L9-VH6-L10-VL6-L11-VH5-L12-VL4-CH1-CL; VH4-L8-VL5-L9-VH6-L10-VL6-L11-VH5-L12-VL4-CL-CH1; VL4-L8-VL5-L9-VL6-L10-VH6-L11-VH5-L12-VH4-L13-CH1; VL4-L8-VL5-L9-VL6-L10-VH6-L11-VH5-L12-VH4-L13-CL; VL4-L8-VL5-L9-VL6-L10-VH6-L11-VH5-L12-VH4-L13-CH1-CL; VL4-L8-VL5-L9-VL6-L10-VH6-L11-VH5-L12-VH4-L13-CL-CH1; VH4-L8-VH5-L9-VH6-L10-VL6-L11-VL5-L12-VL4-L13-CH1; VH4-L8-VH5-L9-VH6-L10-VL6-L11-VL5-L12-VL4-L13-CL; VH4-L8-VH5-L9-VH6-L10-VL6-L11-VL5-L12-VL4-L13-CH1-CL; VH4-L8-VH5-L9-VH6-L10-VL6-L11-VL5-L12-VL4-L13-CL-CH1; VL4-L8-VH5-L9-VL6-L10-VH6-L11-VL5-L12-VH4-L13-CH1; VL4-L8-VH5-L9-VL6-L10-VH6-L11-VL5-L12-VH4-L13-CL; VL4-L8-VH5-L9-VL6-L10-VH6-L11-VL5-L12-VH4-L13-CH1-CL; VL4-L8-VH5-L9-VL6-L10-VH6-L11-VL5-L12-VH4-L13-CL-CH1; VH4-L8-VL5-L9-VH6-L10-VL6-L11-VH5-L12-VL4-L13-CH1; VH4-L8-VL5-L9-VH6-L10-VL6-L11-VH5-L12-VL4-L13-CL; VH4-L8-VL5-L9-VH6-L10-VL6-L11-VH5-L12-VL4-L13-CH1-CL; or VH4-L8-VL5-L9-VH6-L10-VL6-L11-VH5-L12-VL4-L13-CL-CH1; VL4-L8-VL5-L9-VH6-L10-VL6-L11-VH5-L12-VH4-CH1; VL4-L8-VL5-L9-VH6-L10-VL6-L11-VH5-L12-VH4-CL; VL4-L8-VL5-L9-VH6-L10-VL6-L11-VH5-L12-VH4-CH1-CL; VL4-L8-VL5-L9-VH6-L10-VL6-L11-VH5-L12-VH4-CL-CH1; VH4-L8-VH5-L9-VL6-L10-VH6-L11-VL5-L12-VL4-CH1; VH4-L8-VH5-L9-VL6-L10-VH6-L11-VL5-L12-VL4-CL; VH4-L8-VH5-L9-VL6-L10-VH6-L11-VL5-L12-VL4-CH1-CL; VH4-L8-VH5-L9-VL6-L10-VH6-L11-VL5-L12-VL4-CL-CH1; VL4-L8-VL5-L9-VH6-L10-VL6-L11-VH5-L12-VH4-L13-CH1; VL4-L8-VL5-L9-VH6-L10-VL6-L11-VH5-L12-VH4-L13-CL; VL4-L8-VL5-L9-VH6-L10-VL6-L11-VH5-L12-VH4-L13-CH1-CL; VL4-L8-VL5-L9-VH6-L10-VL6-L11-VH5-L12-VH4-L13-CL-CH1; VH4-L8-VH5-L9-VL6-L10-VH6-L11-VL5-L12-VL4-L13-CH1; VH4-L8-VH5-L9-VL6-L10-VH6-L11-VL5-L12-VL4-L13-CL; VH4-L8-VH5-L9-VL6-L10-VH6-L11-VL5-L12-VL4-L13-CH1-CL; or VH4-L8-VH5-L9-VL6-L10-VH6-L11-VL5-L12-VL4-L13-CL-CH1; wherein VL1 is a first immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL2 is a second immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL3 is a third immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL4 is a fourth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL5 is a fifth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL6 is a sixth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH1 is a first immunoglobulin heavy chain variable region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH2 is a second immuno-globulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH3 is a third immunoglobulin heavy chain vari-able region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH4 is a fourth immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH5 is a fifth immunoglobulin heavy chain variable region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH6 is a sixth immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cad-herin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; CH1 is a heavy chain constant region 1; CL is a light chain constant region; and L1, L2, L3, L4, L5, L6, L7, L8, L9, L10, L11, L12 and L13 are amino acid linkers. For the avoidance of doubt, all the antigen binding polypeptide structures described herein can be combined with any one or more of the targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VL4, VL5, VL6, VH1, VH2, VH3, VH4, VH5 and/or VH6 of each and every antigen binding polypeptide and antigen binding polypeptide complex described herein may independently bind to any one of said particularly preferred targets.

In some aspects, the antigen binding polypeptide complex comprises a first polypeptide and a second polypeptide; wherein the first polypeptide has a structure represented by VL1-VL2-VL3-VH3-VH2-VH1-CH1-Fc; VH1-VH2-VH3-VL3-VL2-VL1-CH1-Fc; VL1-VH2-VL3-VH3-VL2-VH1-CH1-Fc; VH1-VL2-VH3-VL3-VH2-VL1-CH1-Fc; VL1-VL2-VH3-VL3-VH2-VH1-CH1-Fc; VH1-VH2-VL3-VH3-VL2-VL1-CH1-Fc; VL1-VH2-VH3-VL3-VL2-VH1-CH1-Fc; VH1-VL2-VL3-VH3-VH2-VL1-CH1-Fc; VL1-VL2-VL3-VH3-VH2-VH1-CL-Fc; VH1-VH2-VH3-VL3-VL2-VL1-CL-Fc; VL1-VH2-VL3-VH3-VL2-VH1-CL-Fc; VH1-VL2-VH3-VL3-VH2-VL1-CL-Fc; VL1-VL2-VH3-VL3-VH2-VH1-CL-Fc; VH1-VH2-VL3-VH3-VL2-VL1-CL-Fc; VL1-VH2-VH3-VL3-VL2-VH1-CL-Fc; VH1-VL2-VL3-VH3-VH2-VL1-CL-Fc; VL1-VL2-VL3-VH3-VH2-VH1-

CH1-CL-Fc; VH1-VH2-VH3-VL3-VL2-VL1-CH1-CL-Fc; VL1-VH2-VL3-VH3-VL2-VH1-CH1-CL-Fc; VH1-VL2-VH3-VL3-VH2-VL1-CH1-CL-Fc; VL1-VL2-VH3-VL3-VH2-VH1-CH1-CL-Fc; VH1-VH2-VL3-VH3-VL2-VL1-CH1-CL-Fc; VL1-VH2-VH3-VL3-VL2-VH1-CH1-CL-Fc; VH1-VL2-VL3-VH3-VH2-VL1-CH1-CL-Fc; VL1-VL2-VL3-VH3-VH2-VH1-CL-CH1-Fc; VH1-VH2-VH3-VL3-VL2-VL1-CL-CH1-Fc; VL1-VH2-VL3-VH3-VL2-VH1-CL-CH1-Fc; VH1-VL2-VH3-VL3-VH2-VL1-CL-CH1-Fc; VL1-VL2-VH3-VL3-VH2-VH1-CL-CH1-Fc; VH1-VH2-VL3-VH3-VL2-VL1-CL-CH1-Fc; VL1-VH2-VH3-VL3-VL2-VH1-CL-CH1-Fc; VH1-VL2-VL3-VH3-VH2-VL1-CL-CH1-Fc; VL1-L1-VL2-L2-VL3-L3-VH3-L4-VH2-L5-VH1-CH1-Fc; VH1-L1-VH2-L2-VH3-L3-VL3-L4-VL2-L5-VL1-CH1-Fc; VL1-L1-VH2-L2-VL3-L3-VH3-L4-VL2-L5-VH1-CH1-Fc; VH1-L1-VL2-L2-VH3-L3-VL3-L4-VH2-L5-VL1-CH1-Fc; VL1-L1-VL2-L2-VH3-L3-VL3-L4-VH2-L5-VH1-CH1-Fc; VH1-L1-VH2-L2-VL3-L3-VH3-L4-VL2-L5-VL1-CH1-Fc; VL1-L1-VH2-L2-VH3-L3-VL3-L4-VL2-L5-VH1-CH1-Fc; VH1-L1-VL2-L2-VL3-L3-VH3-L4-VH2-L5-VL1-CH1-Fc; VL1-L1-VL2-L2-VL3-L3-VH3-L4-VH2-L5-VH1-CL-Fc; VH1-L1-VH2-L2-VH3-L3-VL3-L4-VL2-L5-VL1-CL-Fc; VL1-L1-VH2-L2-VL3-L3-VH3-L4-VL2-L5-VH1-CL-Fc; VH1-L1-VL2-L2-VH3-L3-VL3-L4-VH2-L5-VL1-CL-Fc; VL1-L1-VL2-L2-VH3-L3-VL3-L4-VH2-L5-VH1-CL-Fc; VH1-L1-VH2-L2-VL3-L3-VH3-L4-VL2-L5-VL1-CL-Fc; VL1-L1-VH2-L2-VH3-L3-VL3-L4-VL2-L5-VH1-CL-Fc; VH1-L1-VL2-L2-VL3-L3-VH3-L4-VH2-L5-VL1-CL-Fc; VL1-L1-VL2-L2-VL3-L3-VH3-L4-VH2-L5-VH1-CH1-CL-Fc; VH1-L1-VH2-L2-VH3-L3-VL3-L4-VL2-L5-VL1-CH1-CL-Fc; VL1-L1-VH2-L2-VL3-L3-VH3-L4-VL2-L5-VH1-CH1-CL-Fc; VH1-L1-VL2-L2-VH3-L3-VL3-L4-VH2-L5-VL1-CH1-CL-Fc; VL1-L1-VL2-L2-VH3-L3-VL3-L4-VH2-L5-VH1-CH1-CL-Fc; VH1-L1-VH2-L2-VL3-L3-VH3-L4-VL2-L5-VL1-CH1-CL-Fc; VL1-L1-VH2-L2-VH3-L3-VL3-L4-VL2-L5-VH1-CH1-CL-Fc; VH1-L1-VL2-L2-VL3-L3-VH3-L4-VH2-L5-VL1-CH1-CL-Fc; VL1-L1-VL2-L2-VL3-L3-VH3-L4-VH2-L5-VH1-CL-CH1-Fc; VH1-L1-VH2-L2-VH3-L3-VL3-L4-VL2-L5-VL1-CL-CH1-Fc; VL1-L1-VH2-L2-VL3-L3-VH3-L4-VL2-L5-VH1-CL-CH1-Fc; VH1-L1-VL2-L2-VH3-L3-VL3-L4-VH2-L5-VL1-CL-CH1-Fc; VL1-L1-VL2-L2-VH3-L3-VL3-L4-VH2-L5-VH1-CL-CH1-Fc; or VH1-L1-VL2-L2-VL3-L3-VH3-L4-VH2-L5-VL1-CL-CH1-Fc; wherein the second polypeptide has a structure represented by Fc; VL4-VH4-CH1-Fc; VL4-VH4-CL-Fc; VL4-VH4-CH1-CL-Fc; VL4-VH4-CL-CH1-Fc; VH4-VL4-CH1-Fc; VH4-VL4-CL-Fc; VH4-VL4-CH1-CL-Fc; VH4-VL4-CL-CH1-Fc; VL4-L6-VH4-CH1-Fc; VL4-L6-VH4-CL-Fc; VL4-L6-VH4-CH1-CL-Fc; VL4-L6-VH4-CL-CH1-Fc; VH4-L6-VL4-CH1-Fc; VH4-L6-VL4-CL-Fc; VH4-L6-VL4-CH1-CL-Fc; VH4-L6-VL4-CL-CH1-Fc; VL4-VL5-VH5-VH4-CH1-Fc; VL4-VL5-VH5-VH4-CL-Fc; VL4-VL5-VH5-VH4-CH1-CL-Fc; VL4-VL5-VH5-VH4-CL-CH1-Fc; VH4-VH5-VL5-VL4-CH1-Fc; VH4-VH5-VL5-VL4-CL-Fc; VH4-VH5-VL5-VL4-CH1-CL-Fc; VH4-VH5-VL5-VL4-CL-CH1-Fc; VL4-L6-VL5-L7-VH5-L8-VH4-CH1-Fc; VL4-L6-VL5-L7-VH5-L8-VH4-CL-Fc; VL4-L6-VL5-L7-VH5-L8-VH4-CH1-CL-Fc; VL4-L6-VL5-L7-VH5-L8-VH4-CL-CH1-Fc; VH4-L6-VH5-L7-VL5-L8-VL4-CH1-Fc; VH4-L6-VH5-L7-VL5-L8-VL4-CL-Fc; VH4-L6-VH5-L7-VL5-L8-VL4-CH1-CL-Fc; VH4-L6-VH5-L7-VL5-L8-VL4-CL-CH1-Fc; VL4-VL5-VL6-VH6-VH5-VH4-

CL-Fc; VL4-VL5-VL6-VH6-VH5-VH4-CH1-CL-Fc; VL4-VL5-VL6-VH6-VH5-VH4-CL-CH1-Fc; VH4-VH5-VH6-VL6-VL5-VL4-CH1-Fc; VH4-VH5-VH6-VL6-VL5-VL4-CL-Fc; VH4-VH5-VH6-VL6-VL5-VL4-CH1-CL-Fc; VH4-VH5-VH6-VL6-VL5-VL4-CL-CH1-Fc; VL4-VH5-VL6-VH6-VL5-VH4-CH1-Fc; VL4-VH5-VL6-VH6-VL5-VH4-CL-Fc; VL4-VH5-VL6-VH6-VL5-VH4-CH1-CL-Fc; VL4-VH5-VL6-VH6-VL5-VH4-CL-CH1-Fc; VH4-VL5-VH6-VL6-VH5-VL4-CH1-Fc; VH4-VL5-VH6-VL6-VH5-VL4-CL-Fc; VH4-VL5-VH6-VL6-VH5-VL4-CH1-CL-Fc; VH4-VL5-VH6-VL6-VH5-VL4-CL-CH1-Fc; VL4-VL5-VH6-VL6-VH5-VH4-CH1-Fc; VL4-VL5-VH6-VL6-VH5-VH4-CL-Fc; VL4-VL5-VH6-VL6-VH5-VH4-CH1-CL-Fc; VL4-VL5-VH6-VL6-VH5-VH4-CL-CH1-Fc; VH4-VH5-VL6-VH6-VL5-VL4-CH1-Fc; VH4-VH5-VL6-VH6-VL5-VL4-CL-Fc; VH4-VH5-VL6-VH6-VL5-VL4-CH1-CL-Fc; VH4-VH5-VL6-VH6-VL5-VL4-CL-CH1-Fc; VL4-VH5-VH6-VL6-VL5-VH4-CH1-Fc; VL4-VH5-VH6-VL6-VL5-VH4-CL-Fc; VL4-VH5-VH6-VL6-VL5-VH4-CH1-CL-Fc; VL4-VH5-VH6-VL6-VL5-VH4-CL-CH1-Fc; VH4-VL5-VL6-VH6-VH5-VL4-CH1-Fc; VH4-VL5-VL6-VH6-VH5-VL4-CL-Fc; VH4-VL5-VL6-VH6-VH5-VL4-CH1-CL-Fc; VH4-VL5-VL6-VH6-VH5-VL4-CL-CH1-Fc; VL4-L6-VL5-L7-VL6-L8-VH6-L9-VH5-L10-VH4-CH1-Fc; VL4-L6-VL5-L7-VL6-L8-VH6-L9-VH5-L10-VH4-CL-Fc; VL4-L6-VL5-L7-VL6-L8-VH6-L9-VH5-L10-VH4-CH1-CL-Fc; VL4-L6-VL5-L7-VL6-L8-VH6-L9-VH5-L10-VH4-CL-CH1-Fc; VH4-L6-VH5-L7-VH6-L8-VL6-L9-VL5-L10-VL4-CH1-Fc; VH4-L6-VH5-L7-VH6-L8-VL6-L9-VL5-L10-VL4-CL-Fc; VH4-L6-VH5-L7-VH6-L8-VL6-L9-VL5-L10-VL4-CH1-CL-Fc; VH4-L6-VH5-L7-VH6-L8-VL6-L9-VL5-L10-VL4-CL-CH1-Fc; VL4-L6-VH5-L7-VL6-L8-VH6-L9-VL5-L10-VH4-CH1-Fc; VL4-L6-VH5-L7-VL6-L8-VH6-L9-VL5-L10-VH4-CL-Fc; VL4-L6-VH5-L7-VL6-L8-VH6-L9-VL5-L10-VH4-CH1-CL-Fc; VL4-L6-VH5-L7-VL6-L8-VH6-L9-VL5-L10-VH4-CL-CH1-Fc; VH4-L6-VL5-L7-VH6-L8-VL6-L9-VH5-L10-VL4-CH1-Fc; VH4-L6-VL5-L7-VH6-L8-VL6-L9-VH5-L10-VL4-CL-Fc; VH4-L6-VL5-L7-VH6-L8-VL6-L9-VH5-L10-VL4-CH1-CL-Fc; VH4-L6-VL5-L7-VH6-L8-VL6-L9-VH5-L10-VL4-CL-CH1-Fc; VL4-L6-VL5-L7-VH6-L8-VL6-L9-VH5-L10-VH4-CH1-Fc; VL4-L6-VL5-L7-VH6-L8-VL6-L9-VH5-L10-VH4-CL-Fc; VL4-L6-VL5-L7-VH6-L8-VL6-L9-VH5-L10-VH4-CH1-CL-Fc; VL4-L6-VL5-L7-VH6-L8-VL6-L9-VH5-L10-VH4-CL-CH1-Fc; VH4-L6-VH5-L7-VL6-L8-VH6-L9-VL5-L10-VL4-CH1-Fc; VH4-L6-VH5-L7-VL6-L8-VH6-L9-VL5-L10-VL4-CL-Fc; VH4-L6-VH5-L7-VL6-L8-VH6-L9-VL5-L10-VL4-CH1-CL-Fc; VH4-L6-VH5-L7-VL6-L8-VH6-L9-VL5-L10-VL4-CL-CH1-Fc; VL4-L6-VH5-L7-VH6-L8-VL6-L9-VL5-L10-VH4-CH1-Fc; VL4-L6-VH5-L7-VH6-L8-VL6-L9-VL5-L10-VH4-CL-Fc; VL4-L6-VH5-L7-VH6-L8-VL6-L9-VL5-L10-VH4-CH1-CL-Fc; VL4-L6-VH5-L7-VH6-L8-VL6-L9-VL5-L10-VH4-CL-CH1-Fc; VH4-L6-VL5-L7-VL6-L8-VH6-L9-VH5-L10-VL4-CH1-Fc; VH4-L6-VL5-L7-VL6-L8-VH6-L9-VH5-L10-VL4-CL-Fc; VH4-L6-VL5-L7-VL6-L8-VH6-L9-VH5-L10-VL4-CH1-CL-Fc; VH4-L6-VL5-L7-VL6-L8-VH6-L9-VH5-L10-VL4-CL-CH1-Fc; VL4-L6-VL5-L7-VL6-L8-VH6-L9-VH5-L10-VH4-L11-CH1-Fc; VL4-L6-VL5-L7-VL6-L8-VH6-L9-VH5-L10-VH4-L11-CL-Fc; VL4-L6-VL5-L7-VL6-L8-VH6-L9-VH5-L10-VH4-L11-CH1-CL-Fc; VL4-L6-VL5-L7-VL6-L8-VH6-L9-VH5-L10-VH4-L11-CL-CH1-Fc; VH4-L6-VH5-L7-VH6-L8-VL6-L9-VL5-L10-VL4-L11-CH1-Fc; VH4-L6-VH5-L7-VH6-L8-VL6-L9-VL5-L10-VL4-L11-CL-Fc; VH4-L6-VH5-L7-VH6-L8-VL6-L9-VL5-L10-VL4-L11-CH1-CL-

Fc; VH4-L6-VH5-L7-VH6-L8-VL6-L9-VL5-L10-VL4-L11-CL-CH1-Fc; VL4-L6-VH5-L7-VL6-L8-VH6-L9-VL5-L10-VH4-L11-CH1-Fc; VL4-L6-VH5-L7-VL6-L8-VH6-L9-VL5-L10-VH4-L11-CL-Fc; VL4-L6-VH5-L7-VL6-L8-VH6-L9-VL5-L10-VH4-L11-CH1-CL-Fc; VL4-L6-VH5-L7-VL6-L8-VH6-L9-VL5-L10-VH4-L11-CL-CH1-Fc; VH4-L6-VL5-L7-VH6-L8-VL6-L9-VH5-L10-VL4-L11-CH1-Fc; VH4-L6-VL5-L7-VH6-L8-VL6-L9-VH5-L10-VL4-L11-CL-Fc; VH4-L6-VL5-L7-VH6-L8-VL6-L9-VH5-L10-VL4-L11-CH1-CL-Fc; or VH4-L6-VL5-L7-VH6-L8-VL6-L9-VH5-L10-VL4-L11-CL-CH1-Fc; VL4-L6-VL5-L7-VH6-L8-VL6-L9-VH5-L10-VH4-L11-CH1-Fc; VL4-L6-VL5-L7-VH6-L8-VL6-L9-VH5-L10-VH4-L11-CL-Fc; VL4-L6-VL5-L7-VH6-L8-VL6-L9-VH5-L10-VH4-L11-CH1-CL-Fc; VL4-L6-VL5-L7-VH6-L8-VL6-L9-VH5-L10-VH4-L11-CL-CH1-Fc; VH4-L6-VH5-L7-VL6-L8-VH6-L9-VL5-L10-VL4-L11-CH1-Fc; VH4-L6-VH5-L7-VL6-L8-VH6-L9-VL5-L10-VL4-L11-CL-Fc; VH4-L6-VH5-L7-VL6-L8-VH6-L9-VL5-L10-VL4-L11-CH1-CL-Fc; VH4-L6-VH5-L7-VL6-L8-VH6-L9-VL5-L10-VL4-L11-CL-CH1-Fc; VH4-L6-VH5-L7-VL6-L8-VH6-L9-VL5-L10-VL4-L11-CL-CH1-Fc; VL4-L6-VH5-L7-VH6-L8-VL6-L9-VH5-L10-VL4-L11-CH1-Fc; VL4-L6-VH5-L7-VH6-L8-VL6-L9-VH5-L10-VL4-L11-CL-Fc; VL4-L6-VH5-L7-VH6-L8-VL6-L9-VH5-L10-VH4-L11-CH1-CL-Fc; VL4-L6-VL5-L7-VH6-L8-VL6-L9-VH5-L10-VH4-L11-CH1-CL-Fc; VH4-L6-VL5-L7-VL6-L8-VH6-L9-VH5-L10-VL4-L11-CH1-Fc; VH4-L6-VL5-L7-VL6-L8-VH6-L9-VH5-L10-VL4-L11-CL-Fc; VH4-L6-VL5-L7-VH6-L8-VL6-L9-VH5-L10-VL4-L11-CH1-CL-Fc; or VH4-L6-VL5-L7-VH6-L8-VL6-L9-VH5-L10-VL4-L11-CL-CH1-Fc; wherein VL1 is a first immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL2 is a second immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL3 is a third immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL4 is a fourth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase- 1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL5 is a fifth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL6 is a sixth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH1 is a first immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH2 is a second immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH3 is a third immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH4 is a fourth immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH5 is a fifth immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH6 is a sixth immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; Fc is a region comprising an immunoglobulin heavy chain constant region 2 (CH2), an immunoglobulin heavy chain constant region 3 (CH3), and optionally, an immunoglobulin hinge; CH1 is a heavy chain constant region 1; CL is a light chain constant region; and L1, L2, L3, L4, L5, L6, L7, L8, L9, L10 and L11 are amino acid linkers. For the avoidance of doubt, all the antigen binding polypeptide structures described herein can be combined with any one or more of the targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VL4, VL5, VL6, VH1, VH2, VH3, VH4, VH5 and/or VH6 of each and every antigen binding polypeptide and antigen binding polypeptide complex described herein may independently bind to any one of said particularly preferred targets.

In some aspects, the invention is directed to an antigen binding polypeptide or antigen binding polypeptide complex comprising a polypeptide having a structure represented by VL1-VL2-VL3-VH3-VH2-VH1-CH3-CH3; VH1-VH2-VH3-VL3-VL2-VL1-CH3-CH3; VL1-VH2-VL3-VH3-VL2-VH1-CH3-CH3; VH1-VL2-VH3-VL3-VH2-VL1-CH3-CH3; VL1-VL2-VH3-VL3-VH2-VH1-CH3-CH3; VH1-VH2-VL3-VH3-VL2-VL1-CH3-CH3; VL1-VH2-VH3-VL3-VL2-VH1-CH3-CH3; VH1-VL2-VL3-VH3-VH2-VL1-CH3-CH3; VL1-L1-VL2-L2-VL3-L3-VH3-L4-VH2-L5-VH1-CH3-CH3; VH1-L1-VH2-L2-VH3-L3-VL3-L4-VL2-L5-VL1-CH3-CH3; VL1-L1-VH2-L2-VL3-L3-VH3-L4-VL2-L5-VH1-CH3-CH3; VH1-L1-VL2-L2-VH3-L3-VL3-L4-VH2-L5-VL1-CH3-CH3; VL1-L1-VL2-L2-VH3-L3-VL3-L4-VH2-L5-VH1-CH3-CH3; VH1-L1-VH2-L2-VL3-L3-VH3-L4-VL2-L5-VL1-CH3-CH3; VL1-L1-VH2-L2-VH3-L3-VL3-L4-VL2-L5-VH1-CH3-CH3; VH1-L1-VL2-L2-VL3-L3-VH3-L4-VH2-L5-VL1-CH3-CH3; VL1-L1-VL2-L2-VL3-L3-VH3-L4-VH2-L5-VH1-L6-CH3-CH3; VH1-L1-VH2-L2-VH3-L3-VL3-L4-VL2-L5-VL1-L6-CH3-CH3; VL1-L1-VH2-L2-VL3-L3-VH3-L4-VL2-L5-VH1-L6-CH3-CH3; VH1-L1-VL2-L2-VH3-L3-

VL3-L4-VH2-L5-VL1-L6-CH3-CH3; VL1-L1-VL2-L2-VH3-L3-VL3-L4-VH2-L5-VH1-L6-CH3-CH3; VH1-L1-VH2-L2-VL3-L3-VH3-L4-VL2-L5-VL1-L6-CH3-CH3; VL1-L1-VH2-L2-VH3-L3-VL3-L4-VL2-L5-VH1-L6-CH3-CH3; VH1-L1-VL2-L2-VL3-L3-VH3-L4-VH2-L5-VL1-L6-CH3-CH3; VL1-L1-VL2-L2-VL3-L3-VH3-L4-VH2-L5-VH1-L6-CH3-L7-CH3; VH1-L1-VH2-L2-VH3-L3-VL3-L4-VL2-L5-VL1-L6-CH3-L7-CH3; VL1-L1-VH2-L2-VL3-L3-VH3-L4-VL2-L5-VH1-L6-CH3-L7-CH3; VH1-L1-VL2-L2-VH3-L3-VL3-L4-VH2-L5-VL1-L6-CH3-L7-CH3; VL1-L1-VL2-L2-VH3-L3-VL3-L4-VH2-L5-VH1-L6-CH3-L7-CH3; VH1-L1-VH2-L2-VL3-L3-VH3-L4-VL2-L5-VL1-L6-CH3-L7-CH3; VH1-L1-VH2-L2-VL3-L3-VH3-L4-VH2-L5-VL1-L6-CH3-L7-CH3; wherein VL1 is a first immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL2 is a second immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL3 is a third immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH1 is a first immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH2 is a second immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH3 is a third immunoglobulin heavy chain variable region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; CH3 is an immunoglobulin heavy chain constant region 3; and L1, L2, L3, L4, L5, L6 and L7 are amino acid linkers. In some aspects, the antigen binding polypeptide has the structure represented by VL1-VL2-VL3-VH3-VH2-VH1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-VH2-VH3-VL3-VL2-VL1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VL1-VH2-VL3-VH3-VL2-VH1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-VL2-VH3-VL3-VH2-VL1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VL1-VL2-VH3-VL3-VH2-VH1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-VH2-VL3-VH3-VL2-VL1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VL1-VH2-VH3-VL3-VL2-VH1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-VL2-VL3-VH3-VH2-VL1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VL1-L1-VL2-L2-VL3-L3-VH3-L4-VH2-L5-VH1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-L1-VH2-L2-VH3-L3-VL3-L4-VL2-L5-VL1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VL1-L1-VH2-L2-VL3-L3-VH3-L4-VL2-L5-VH1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-L1-VL2-L2-VH3-L3-VL3-L4-VH2-L5-VL1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VL1-L1-VL2-L2-VH3-L3-VL3-L4-VH2-L5-VH1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-L1-VH2-L2-VL3-L3-VH3-L4-VL2-L5-VL1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VL1-L1-VH2-L2-VH3-L3-VL3-L4-VL2-L5-VH1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-L1-VL2-L2-VL3-L3-VH3-L4-VH2-L5-VL1-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VL1-L1-VL2-L2-VL3-L3-VH3-L4-VH2-L5-VH1-L6-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-L1-VH2-L2-VH3-L3-VL3-L4-VL2-L5-VL1-L6-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VL1-L1-VH2-L2-VL3-L3-VH3-L4-VL2-L5-VH1-L6-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-L1-VL2-L2-VH3-L3-VL3-L4-VH2-L5-VL1-L6-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VL1-L1-VL2-L2-VH3-L3-VL3-L4-VH2-L5-VH1-L6-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-L1-VH2-L2-VL3-L3-VH3-L4-VL2-L5-VL1-L6-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VL1-L1-VH2-L2-VH3-L3-VL3-L4-VL2-L5-VH1-L6-CH3-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-L1-VL2-L2-VL3-L3-VH3-L4-VH2-L5-VL1-L6-CH3-

CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VL1-L1-VL2-L2-VL3-L3-VH3-L4-VH2-L5-VH1-L6-CH3-L7-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-L1-VH2-L2-VH3-L3-VL3-L4-VL2-L5-VL1-L6-CH3-L7-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VL1-L1-VH2-L2-VL3-L3-VH3-L4-VL2-L5-VH1-L6-CH3-L7-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-L1-VL2-L2-VH3-L3-VL3-L4-VH2-L5-VL1-L6-CH3-L7-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-L1-VL2-L2-VH3-L3-VL3-L4-VH2-L5-VL1-L6-CH3-L7-

ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VL1-L1-VL2-L2-VH3-L3-VL3-L4-VH2-L5-VH1-L6-CH3-L7-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-L1-VH2-L2-VL3-L3-VH3-L4-VL2-L5-VL1-L6-CH3-L7-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VL1-L1-VH2-L2-VH3-L3-VL3-L4-VL2-L5-VH1-L6-CH3-L7-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. In some aspects, the antigen binding polypeptide has the structure represented by VH1-L1-VL2-L2-VL3-L3-VH3-L4-VH2-L5-VL1-L6-CH3-L7-CH3, wherein VL1, VL2, VL3, VH1, VH2 and/or VH3 specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For the avoidance of doubt, all the antigen binding polypeptide structures described herein can be combined with any one or more of the targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VH1, VH2, and/or VH3 of each and every antigen binding polypeptide and antigen binding polypeptide complex described herein may independently bind to any one of said particularly preferred targets.

In some aspects, an antigen binding polypeptide complex of the invention comprises first polypeptide, a second polypeptide, and a third polypeptide; wherein the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VL3-L3-VH3-L4-VL2-L5-VH1; or VH1-L1-VL2-L2-VL3-L3-VH3-L4-VH2-L5-VL1; wherein the second polypeptide has a structure represented by VL4-VL5; VL4-L6-VL5; VL4-VL5-VL6; or VL4-L6-VL5-L7-VL6; wherein the third polypeptide has a structure represented by VH4-VH5; VH4-L8-VH5; VH4-VH5-VH6; or VH4-L8-VH5-L9-VH6; wherein VL1 is a first immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL2 is a second immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL3 is a third immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL4 is a fourth immunoglobulin light chain variable region that specifically binds A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase- 1, OX40, OX40L, PD-1, PD-L1, PD-L2, PROM1, 5152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL5 is a fifth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL6 is a sixth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH1 is a first immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH2 is a second immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH3 is a third immunoglobulin heavy chain variable region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH4 is a fourth immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH5 is a fifth immunoglobulin heavy chain variable region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH6 is a sixth immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; and L1, L2, L3, L4, L5, L6, L7, L8 and L9 are amino acid linkers. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VH2-L2-VH3-L3-VL3-L4-VH2-L5-VH1; or VH1-L1-VL2-L2-VL3-L3-VH3-L4-VH2-L5-VL1; the second polypeptide may have the structure represented by VL4-VL5; and the third polypeptide may have the structure represented by VH4-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VH2-L2-VH3-L3-VL3-L4-VH2-L5-VH1; or VH1-L1-VL2-L2-VL3-L3-VH3-L4-VH2-L5-VL1; the second polypeptide may have the structure represented by VL4-VL5; and the third polypeptide may have the structure represented by VH4-L8-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VH2-L2-VH3-L3-VL3-L4-VH2-L5-VH1; or VH1-L1-VL2-L2-VL3-L3-VH3-L4-VH2-L5-VL1;

VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VH3-L4-VL2-L5-VH1; or VH1-L1-VL2-L2-VL3-L3-VH3-L4-VH2-L5-VL1; the second polypeptide may have the structure represented by VL4-VL5; and the third polypeptide may have the structure represented by VH4-VH5-VH6. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-VL5; and the third polypeptide may have the structure represented by VH4-L8-VH5-L9-VH6. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; or VH1-L1-VL2-L2-VL3-L3-VH3-L4-VH2-L5-VL1; the second polypeptide may have the structure represented by VL4-L6-VL5; and the third polypeptide may have the structure represented by VH4-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VH2-L5-VH1; or VH1-L1-VL2-L2-VL3-L3-VH3-L4-VH2-L5-VL1; the second polypeptide may have the structure represented by VL4-L6-VL5; and the third polypeptide may have the structure represented by VH4-L8-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VL2-L2-VH3-L3-VL3-L4-VH2-L5-VH1; VH1-L1-

VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-L6-VL5; and the third polypeptide may have the structure represented by VH4-VH5-VH6. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-L6-VL5; and the third polypeptide may have the structure represented by VH4-L8-VH5-L9-VH6. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-VL5-VL6; and the third polypeptide may have the structure represented by VH4-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-L6-VL5; and the third polypeptide may have the structure represented by VH4-L8-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-VL5-VL6; and the third polypeptide may have the structure represented by VH4-VH5-VH6. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; or VH1-L1-VL2-L2-VL3-L3-VH3-L4-VH2-L5-VL1; the second polypeptide may have the structure represented by VL4-VL5-VL6; and the third polypeptide may have the structure represented by VH4-L8-VH5-L9-VH6. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-L6-VL5-L7-VL6; and the third polypeptide may have the structure represented by VH4-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-L6-VL5-L7-VL6; and the third polypeptide may have the structure represented by VH4-L8-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-L6-VL5-L7-VL6; and the third polypeptide may have the structure represented by VH4-VH5-VH6. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-L6-VL5-L7-VL6; and the third polypeptide may have the structure represented by VH4-L8-VH5-L9-VH6. The VL1, VL2, VL3, VL4, VL5, VL6, VH1, VH2, VH3, VH4, VH5 and/or VL6 may specifically bind to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, IL1A, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For the avoidance of doubt, all the antigen binding polypeptide structures described herein can be combined with any one or more of the targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VL4, VL5, VL6, VH1, VH2, VH3, VH4, VH5 and/or VH6 of each and every antigen binding polypeptide and antigen binding polypeptide complex described herein may independently bind to any one of said particularly preferred targets.

In some aspects, an antigen binding polypeptide complex of the invention comprises a first polypeptide, a second polypeptide, and a third polypeptide; wherein the first polypeptide has a structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; VH1-VL2-VL3-VH3-VH2-VL1-Fc; VL1-L1-VL2-L2-

VL3-L3-VH3-L4-VH2-L5-VH1-Fc; VL1-L1-VL2-L2-VL3-L3-VH3-L4-VH2-L5-VH1-L6-Fc; VH1-L1-VH2-L2-VH3-L3-VL3-L4-VL2-L5-VL1-Fc; VH1-L1-VH2-L2-VH3-L3-VL3-L4-VL2-L5-VL1-L6-Fc; VL1-L1-VH2-L2-VL3-L3-VH3-L4-VL2-L5-VH1-Fc; VL1-L1-VH2-L2-VL3-L3-VH3-L4-VL2-L5-VH1-L6-Fc; VH1-L1-VL2-L2-VH3-L3-VL3-L4-VH2-L5-VL1-Fc; VH1-L1-VL2-L2-VH3-L3-VL3-L4-VH2-L5-VL1-L6-Fc; VL1-L1-VL2-L2-VH3-L3-VL3-L4-VH2-L5-VH1-Fc; VL1-L1-VL2-L2-VH3-L3-VL3-L4-VH2-L5-VH1-L6-Fc; VH1-L1-VH2-L2-VL3-L3-VH3-L4-VL2-L5-VL1-Fc; VH1-L1-VH2-L2-VL3-L3-VH3-L4-VL2-L5-VL1-L6-Fc; VL1-L1-VH2-L2-VH3-L3-VL3-L4-VL2-L5-VH1-Fc; VL1-L1-VH2-L2-VH3-L3-VL3-L4-VL2-L5-VH1-L6-Fc; VH1-L1-VL2-L2-VL3-L3-VH3-L4-VH2-L5-VL1-Fc; or VH1-L1-VL2-L2-VL3-L3-VH3-L4-VH2-L5-VL1-L6-Fc; wherein the second polypeptide has a structure represented by VL4-VL5; VL4-L7-VL5; VL4-CL; VL4-L7-CL; VL4-CH1; VL4-L7-CH1; VH4-VH5; VH4-L7-VH5; VH4-CL; VH4-L7-CL; VH4-CH1; VH4-L7-CH1; VL4-VL5-VL6; VL4-L7-VL5-L8-VL6; VL4-VL5-VL6-CL; VL4-L7-VL5-L8-VL6-CL; VL4-L7-VL5-L8-VL6-L9-CL; VL4-VL5-VL6-CH1; VL4-L7-VL5-L8-VL6-CH1; VL4-L7-VL5-L8-VL6-L9-CH1; VH4-VH5-VH6; VH4-L7-VH5-L8-VH6; VH4-VH5-VH6-CL; VH4-L7-VH5-L8-VH6-CL; VH4-L7-VH5-L8-VH6-L9-CL; VH4-VH5-VH6-CH1; VH4-L7-VH5-L8-VH6-CH1; or VH4-L7-VH5-L8-VH6-L9-CH1; wherein the third polypeptide has a structure represented by VH4-VH5-Fc; VH4-L10-VH5-Fc; VH4-L10-VH5-L11-Fc; VH4-CH1-Fc; VH4-L10-CH1-Fc; VH4-L10-CH1-L11-Fc; VH4-CL-Fc; VH4-L10-CL-Fc; VH4-L10-CL-L11-Fc; VH4-VH5-Fc; VH4-L10-VH5-Fc; VH4-L10-VH5-L11-Fc; VH4-VH5-VH6-Fc; VH4-L10-VH5-L11-VH6-Fc; VH4-L10-VH5-L11-VH6-L12-Fc; VH4-VH5-VH6-CH1-Fc; VH4-L10-VH5-L11-VH6-CH1-Fc; VH4-L10-VH5-L11-VH6-L12-CH1-Fc; VH4-L10-VH5-L11-VH6-L12-CH1-L13-Fc; VH4-VH5-VH6-CL-Fc; VH4-L10-VH5-L11-VH6-CL-Fc; VH4-L10-VH5-L11-VH6-L12-CL-Fc; VH4-L10-VH5-L11-VH6-L12-CL-L13-Fc; VL4-VL5-VL6-Fc; VL4-L10-VL5-L11-VL6-Fc; VL4-L10-VL5-L11-VL6-L12-Fc; VL4-VL5-VL6-CH1-Fc; VL4-L10-VL5-L11-VL6-CH1-Fc VL4-L10-VL5-L11-VL6-L12-CH1-Fc; VL4-L10-VL5-L11-VL6-L12-CH1-L13-Fc; VL4-VL5-VL6-CL-Fc; VL4-L10-VL5-L11-VL6-CL-Fc; VL4-L10-VL5-L11-VL6-L12-CL-Fc; or VL4-L10-VL5-L11-VL6-L12-CL-L13-Fc; wherein VL1 is a first immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, IL1A, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL2 is a second immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL3 is a third immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL4 is a fourth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TGFbeta, GP100, GPRC5D, CD30 or CD16A; VL5 is a fifth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VL6 is a sixth immunoglobulin light chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH1 is a first immunoglobulin heavy chain variable region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH2 is a second immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH3 is a third immunoglobulin heavy chain variable region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH4 is a fourth immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH5 is a fifth immunoglobulin heavy chain variable region that specifically binds to A2AR, APRIL, ATP-Dase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A; VH6 is a sixth immunoglobulin heavy chain variable region that specifically binds to A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TGFbeta, GP100, GPRC5D, CD30 or CD16A; Fc is a region comprising an immunoglobulin heavy chain constant region 2 (CH2), an immunoglobulin heavy chain constant region 3 (CH3), and optionally, an immunoglobulin hinge; CH1 is a heavy chain constant region 1; CL is a light chain constant region; and L1, L2, L3, L4, L5, L6, L7, L8, L9, L10, L11, L12 and L13 are amino acid linkers. For the avoidance of doubt, all the antigen binding polypeptide structures described herein can be combined with any one or more of the targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VL4, VL5, VL6, VH1, VH2, VH3, VH4, VH5, and/or VH6 of each and every antigen binding polypeptide and antigen binding polypeptide complex described herein may independently bind to any one of said particularly preferred targets.

In some aspects, one or more of VH1, VH2, VH3, VH4, VH5 and VH6 of an antigen binding polypeptide or antigen binding polypeptide complex described herein can specifically bind to the same antigen or different antigens. In some aspects, one or more of VL1, VL2, VL3, VL4, VL5 and VL6 of an antigen binding polypeptide or antigen binding polypeptide complex described herein can specifically bind to the same antigen or different antigens.

In some aspects, VH1, VL1, VH4 and VL4 of an antigen binding polypeptide or antigen binding polypeptide complex described herein specifically bind to the same antigen. In some aspects, VH2, VL2, VH5 and VL5 of an antigen binding polypeptide or antigen binding polypeptide complex described herein specifically bind to the same antigen. In some aspects, VH3, VL3, VH6 and VL6 of an antigen binding polypeptide or antigen binding polypeptide complex described herein specifically bind to the same antigen. In some aspects, VH1, VL1, VH4 and VL4 of an antigen binding polypeptide or antigen binding polypeptide complex described herein specifically bind to the same antigen; VH2, VL2, VH5 and VL5 of an antigen binding polypeptide or antigen binding polypeptide complex described herein specifically bind to the same antigen; and VH3, VL3, VH6 and VL6 of an antigen binding polypeptide or antigen binding polypeptide complex described herein specifically bind to the same antigen.

In some aspects, the amino acid sequences of VH1 and VH4 of an antigen binding polypeptide or antigen binding polypeptide complex described herein have at least 90% identity, at least 95% identity or 100% identity. In some aspects, the amino acid sequences of VH2 and VH5 of an antigen binding polypeptide or antigen binding polypeptide complex described herein have at least 90% identity, at least 95% identity or 100% identity. In some aspects, the amino acid sequences of VH3 and VH6 of an antigen binding polypeptide or antigen binding polypeptide complex described herein have at least 90% identity, at least 95% identity or 100% identity. In some aspects, the amino acid sequences of VL1 and VL4 of an antigen binding polypeptide or antigen binding polypeptide complex described herein have at least 90% identity, at least 95% identity or 100% identity. In some aspects, the amino acid sequences of VL2 and VL5 of an antigen binding polypeptide or antigen binding polypeptide complex described herein have at least 90% identity, at least 95% identity or 100% identity. In some aspects, the amino acid sequences of VL3 and VL6 of an antigen binding polypeptide or antigen binding polypeptide complex described herein have at least 90% identity, at least 95% identity or 100% identity.

In some aspects, VH1, VH2, VH3 and VH4 of an antigen binding polypeptide or antigen binding polypeptide complex described herein specifically bind to different antigens. In some aspects, VL1, VL2, VL3 and VL4 of an antigen binding polypeptide or antigen binding polypeptide complex described herein specifically bind to different antigens. In some aspects, VH1, VH2, VH3 and VH4 of an antigen binding polypeptide or antigen binding polypeptide complex described herein specifically bind to different antigens; and VL1, VL2, VL3 and VL4 of an antigen binding polypeptide or antigen binding polypeptide complex described herein specifically bind to different antigens. In some aspects, VH1 VH2, VH3 and VH4 each comprise an amino acid sequence having at least 90% identity, at least 95% identity, or 100% identity to any one of SEQ ID NOs:20-24; and VL1, VL2, VL3 and VL4 each comprise an amino acid sequence having at least 90% identity, at least 95% identity, or 100% identity to any one of SEQ ID NOs:25-29. For example, VH1 VH2, VH3 and VH4 each comprise an amino acid sequence having at least 90% identity to any one of SEQ ID NOs: 20-24; and VL1, VL2, VL3 and VL4 each comprise an amino acid sequence having at least 90% identity to any one of SEQ ID NOs:25-29. At least 90% identity may include at least 91%, 92%, 93%, 94%, 95%, 96%, 97%, 98%, 99% or 100% identity to the reference polypeptide sequence. For example, VH1 VH2, VH3 and VH4 may each comprise the amino acid sequence of any one of SEQ ID NOs:20-24; and VL1, VL2, VL3 and VL4 may each comprise the amino acid sequence of any one of SEQ ID NOs:25-29.

In some aspects, VH1, VH2, VH3, VH4 and VH5 of an antigen binding polypeptide or antigen binding polypeptide complex described herein specifically bind to different antigens. In some aspects, VL1, VL2, VL3, VL4 and VL5 of an antigen binding polypeptide or antigen binding polypeptide complex described herein specifically bind to different antigens. In some aspects, VH1, VH2, VH3, VH4 and VH5 of an antigen binding polypeptide or antigen binding polypeptide complex described herein specifically bind to different antigens; and VL1, VL2, VL3, VL4 and VL5 of an antigen binding polypeptide or antigen binding polypeptide complex described herein specifically bind to different antigens. In some aspects, VH1 VH2, VH3, VH4 and VH5 each comprise an amino acid sequence having at least 90% identity, at least 95% identity, or 100% identity to any one of SEQ ID NOs:20-24. For example, VH1 VH2, VH3, VH4 and VH5 may each comprise an amino acid sequence having at least 90% identity to any one of SEQ ID NOs:20-24. At least 90% identity may include at least 91%, 92%, 93%, 94%, 95%, 96%, 97%, 98%, 99% or 100% identity to the reference polypeptide sequence. For example, VH1 VH2, VH3, VH4 and VH5 may each comprise the amino acid sequence of any one of SEQ ID NOs:20-24. In some aspects, VL1, VL2, VL3, VL4 and VL5 each comprise an amino acid sequence having at least 90% identity, at least 95% identity, or 100% identity to any one of SEQ ID NOs:25-29. For example, VL1, VL2, VL3, VL4 and VL5 may each comprise an amino acid sequence having at least 90% identity to any one of SEQ ID NOs:25-29. At least 90% identity may include at least 91%, 92%, 93%, 94%, 95%, 96%, 97%, 98%, 99% or 100% identity to the reference polypeptide sequence. For example, VL1, VL2, VL3, VL4 and VL5 may each comprise the amino acid sequence of any one of SEQ ID NOs:25-29. In some aspects, VH1 VH2, VH3, VH4 and VH5 each comprise an amino acid sequence having at least 90% identity, at least 95% identity, or 100% identity to any one of SEQ ID NOs:20-24 and VL1, VL2, VL3, VL4 and VL5 each comprise an amino acid sequence having at least 90% identity, at least 95% identity, or 100% identity to any one of SEQ ID NOs:25-29. For example, VH1 VH2, VH3, VH4 and VH5 may each comprise an amino acid sequence having at least 90% identity to any one of SEQ ID NOs:20-24 and VL1, VL2, VL3, VL4 and VL5 may each comprise an amino acid sequence having at least 90% identity to any one of SEQ ID NOs:25-29. At least 90% identity may include at least 91%, 92%, 93%, 94%, 95%, 96%, 97%, 98%, 99% or 100% identity to the reference polypeptide sequence. For example, VH1 VH2, VH3, VH4 and VH5 may each comprise the amino acid sequence of any one of SEQ ID NOs:20-24 and VL1, VL2, VL3, VL4 and VL5 may each comprise the amino acid sequence of any one of SEQ ID NOs:25-29.

In some aspects, VH1, VH2, VH3, VH4, VH5 and VH6 of an antigen binding polypeptide or antigen binding polypeptide complex described herein specifically bind to different antigens. In some aspects, VL1, VL2, VL3, VL4, VL5 and VL6 of an antigen binding polypeptide or antigen binding polypeptide complex described herein specifically bind to different antigens. In some aspects, VH1, VH2, VH3, VH4, VH5 and VH6 of an antigen binding polypeptide or antigen binding polypeptide complex described herein specifically bind to different antigens; and VL1, VL2, VL3, VL4, VL5 and VL6 of an antigen binding polypeptide or antigen binding polypeptide complex described herein specifically bind to different antigens. In some aspects, VH1, VH2, VH3, VH4, VH5 and VH6 each comprise an amino acid sequence having at least 90% identity, at least 95% identity, or 100% identity to any one of SEQ ID NOs:20-24. For example, VH1, VH2, VH3, VH4, VH5 and VH6 may each comprise an amino acid sequence having at least 90% identity to any one of SEQ ID NOs:20-24. At least 90% identity may include at least 91%, 92%, 93%, 94%, 95%, 96%, 97%, 98%, 99% or 100% identity to the reference polypeptide sequence. For example, VH1, VH2, VH3, VH4, VH5 and VH6 may each comprise the amino acid sequence of any one of SEQ ID Nos:20-24. In some aspects, VL1, VL2, VL3, VL4, VL5 and VL6 each comprise an amino acid sequence having at least 90% identity, at least 95% identity, or 100% identity to any one of SEQ ID Nos:25-29. For example, VL1, VL2, VL3, VL4, VL5 and VL6 may each comprise an amino acid sequence having at least 90% identity to any one of SEQ ID Nos:25-29. At least 90% identity may include at least 91%, 92%, 93%, 94%, 95%, 96%, 97%, 98%, 99% or 100% identity to the reference polypeptide sequence. For example, VL1, VL2, VL3, VL4, VL5 and VL6 may each comprise the amino acid sequence of any one of SEQ ID Nos:25-29. In some aspects, VH1, VH2, VH3, VH4, VH5 and VH6 each comprise an amino acid sequence having at least 90% identity, at least 95% identity, or 100% identity to any one of SEQ ID NOs:20-24, and VL1, VL2, VL3, VL4, VL5 and VL6 each comprise an amino acid sequence having at least 90% identity, at least 95% identity, or 100% identity to any one of SEQ ID NOs:25-29. For example, VH1, VH2, VH3, VH4, VH5 and VH6 may each comprise an amino acid sequence having at least 90% identity to any one of SEQ ID Nos:20-24, and VL1, VL2, VL3, VL4, VL5 and VL6 may each comprise an amino acid sequence having at least 90% identity to any one of SEQ ID Nos:25-29. At least 90% identity may include at least 91%, 92%, 93%, 94%, 95%, 96%, 97%, 98%, 99% or 100% identity to the reference polypeptide sequence. For example, VH1, VH2, VH3, VH4, VH5 and VH6 may each comprise the amino acid sequence of any one of SEQ ID Nos:20-24, and VL1, VL2, VL3, VL4, VL5 and VL6 may each comprise the amino acid sequence of any one of SEQ ID NOs:25-29.

In some aspects of an antigen binding polypeptide or antigen binding polypeptide complex of the invention, VL1 is a first immunoglobulin light chain variable region that specifically binds to CD28; VL2 is a second immunoglobulin light chain variable region that specifically binds to CD3; VL3 is a third immunoglobulin light chain variable region that specifically binds to CD38; VH1 is a first immunoglobulin heavy chain variable region that specifically binds to CD28; VH2 is a second immunoglobulin heavy chain variable region that specifically binds to CD3; and VH3 is a third immunoglobulin heavy chain variable region that specifically binds to CD38. In some aspects, the antigen binding polypeptide or antigen binding polypeptide complex comprises a polypeptide having a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; wherein VL1 is a first immunoglobulin light chain variable region that specifically binds to CD28; VL2 is a second immunoglobulin light chain variable region that specifically binds to CD3; VL3 is a third immunoglobulin light chain variable region that specifically binds to CD38; VH1 is a first immunoglobulin heavy chain variable region that specifically binds to CD28; VH2 is a second immunoglobulin heavy chain variable region that specifically binds to CD3; VH3 is a third immunoglobulin heavy chain variable region that specifically binds to CD38; and L1, L2, L3, L4 and L5 are amino acid linkers. In some aspects, VH1 comprises an amino acid sequence having at least 90% identity, at least 95% identity, or 100% identity to SEQ ID NO:22; VH2 comprises an amino acid sequence having at least 90% identity, at least 95% identity, or 100% identity to SEQ ID NO:21; VH3 comprises an amino acid sequence having at least 90% identity, at least 95% identity, or 100% identity to SEQ ID NO:20; VL1 comprises an amino acid sequence having at least 90% identity, at least 95% identity, or 100% identity to SEQ ID NO:27; VL2 comprises an amino acid sequence having at least 90% identity, at least 95% identity, or 100% identity to SEQ ID NO:26; and VL3 comprises an amino acid sequence having at least 90% identity, at least 95% identity, or 100% identity to SEQ ID NO:25. For example, VH1 comprises an amino acid sequence having at least 90% identity to SEQ ID NO:22; VH2 comprises an amino acid sequence having at least 90% identity to SEQ ID NO:21; VH3 comprises an amino acid sequence having at least 90% identity to SEQ ID NO:20; VL1 comprises an amino acid sequence having at least 90% identity to SEQ ID NO:27; VL2 comprises an amino acid sequence having at least 90% identity to SEQ ID NO:26; and VL3 comprises an amino acid sequence having at least 90% identity to SEQ ID NO:25. At least 90% identity may include at least 91%, 92%, 93%, 94%, 95%, 96%, 97%, 98%, 99% or 100% identity to the reference polypeptide sequence. For example, VH1 comprises the amino acid sequence of SEQ ID NO:22; VH2 comprises the amino acid sequence of SEQ ID NO:21; VH3 comprises the amino acid sequence of SEQ ID NO:20; VL1 comprises the amino acid sequence of SEQ ID NO:27; VL2 comprises the amino acid sequence of SEQ ID NO:26; and VL3 comprises the amino acid sequence of SEQ ID NO:25.

In other aspects of an antigen binding polypeptide or antigen binding polypeptide complex of the invention, VL1 is a first immunoglobulin light chain variable region that specifically binds to CD3; VL2 is a second immunoglobulin light chain variable region that specifically binds to CD28; VL3 is a third immunoglobulin light chain variable region that specifically binds to CD38; VH1 is a first immunoglobulin heavy chain variable region that specifically binds to CD3; VH2 is a second immunoglobulin heavy chain variable region that specifically binds to CD28; and VH3 is a third immunoglobulin heavy chain variable region that specifically binds to CD38. In some aspects, the antigen binding polypeptide or antigen binding polypeptide complex comprises a polypeptide having a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-

VL1; wherein VL1 is a first immunoglobulin light chain variable region that specifically binds to CD3; VL2 is a second immunoglobulin light chain variable region that specifically binds to CD28; VL3 is a third immunoglobulin light chain variable region that specifically binds to CD38; VH1 is a first immunoglobulin heavy chain variable region that specifically binds to CD3; VH2 is a second immunoglobulin heavy chain variable region that specifically binds to CD28; VH3 is a third immunoglobulin heavy chain variable region that specifically binds to CD38; and L1, L2, L3, L4 and L5 are amino acid linkers. In some aspects, VH1 comprises an amino acid sequence having at least 90% identity, at least 95% identity, or 100% identity to SEQ ID NO:21; VH2 comprises an amino acid sequence having at least 90% identity, at least 95% identity, or 100% identity to SEQ ID NO:22; VH3 comprises an amino acid sequence having at least 90% identity, at least 95% identity, or 100% identity to SEQ ID NO:20; VL1 comprises an amino acid sequence having at least 90% identity, at least 95% identity, or 100% identity to SEQ ID NO:26; VL2 comprises an amino acid sequence having at least 90% identity, at least 95% identity, or 100% identity to SEQ ID NO:27; and VL3 comprises an amino acid sequence having at least 90% identity, at least 95% identity, or 100% identity to SEQ ID NO:25. For example, VH1 comprises an amino acid sequence having at least 90% identity to SEQ ID NO:21; VH2 comprises an amino acid sequence having at least 90% identity to SEQ ID NO:22; VH3 comprises an amino acid sequence having at least 90% identity to SEQ ID NO:20; VL1 comprises an amino acid sequence having at least 90% identity to SEQ ID NO:26; VL2 comprises an amino acid sequence having at least 90% identity to SEQ ID NO:27; and VL3 comprises an amino acid sequence having at least 90% identity to SEQ ID NO:25. At least 90% identity may include at least 91%, 92%, 93%, 94%, 95%, 96%, 97%, 98%, 99% or 100% identity to the reference polypeptide sequence. For example, VH1 comprises the amino acid sequence of SEQ ID NO:21; VH2 comprises the amino acid sequence of SEQ ID NO:22; VH3 comprises the amino acid sequence of SEQ ID NO:20; VL1 comprises the amino acid sequence of SEQ ID NO:26; VL2 comprises the amino acid sequence of SEQ ID NO:27; and VL3 comprises the amino acid sequence of SEQ ID NO:25.

In other aspects of an antigen binding polypeptide or antigen binding polypeptide complex of the invention, VL1 is a first immunoglobulin light chain variable region that specifically binds to CD3; VL2 is a second immunoglobulin light chain variable region that specifically binds to CD38; VL3 is a third immunoglobulin light chain variable region that specifically binds to CD28; VH1 is a first immunoglobulin heavy chain variable region that specifically binds to CD3; VH2 is a second immunoglobulin heavy chain variable region that specifically binds to CD38; and VH3 is a third immunoglobulin heavy chain variable region that specifically binds to CD28. In some aspects, an antigen binding polypeptide or antigen binding polypeptide complex of the invention comprises a polypeptide having a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VL2-L2-VH3-L3-VL3-L4-VH2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-

L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; wherein VL1 is a first immunoglobulin light chain variable region that specifically binds to CD3; VL2 is a second immunoglobulin light chain variable region that specifically binds to CD38; VL3 is a third immunoglobulin light chain variable region that specifically binds to CD28; VH1 is a first immunoglobulin heavy chain variable region that specifically binds to CD3; VH2 is a second immunoglobulin heavy chain variable region that specifically binds to CD38; VH3 is a third immunoglobulin heavy chain variable region that specifically binds to CD28; and L1, L2, L3, L4 and L5 are amino acid linkers. In some aspects, VH1 comprises an amino acid sequence having at least 90% identity, at least 95% identity, or 100% identity to SEQ ID NO:21; VH2 comprises an amino acid sequence having at least 90% identity, at least 95% identity, or 100% identity to SEQ ID NO:20; VH3 comprises an amino acid sequence having at least 90% identity, at least 95% identity, or 100% identity to SEQ ID NO:22; VL1 comprises an amino acid sequence having at least 90% identity, at least 95% identity, or 100% identity to SEQ ID NO:26; VL2 comprises an amino acid sequence having at least 90% identity, at least 95% identity, or 100% identity to SEQ ID NO:25; and VL3 comprises an amino acid sequence having at least 90% identity, at least 95% identity, or 100% identity to SEQ ID NO:27. For example, VH1 comprises an amino acid sequence having at least 90% identity to SEQ ID NO:21; VH2 comprises an amino acid sequence having at least 90% identity to SEQ ID NO:20; VH3 comprises an amino acid sequence having at least 90% identity to SEQ ID NO:22; VL1 comprises an amino acid sequence having at least 90% identity to SEQ ID NO:26; VL2 comprises an amino acid sequence having at least 90% identity to SEQ ID NO:25; and VL3 comprises an amino acid sequence having at least 90% identity to SEQ ID NO:27. At least 90% identity may include at least 91%, 92%, 93%, 94%, 95%, 96%, 97%, 98%, 99% or 100% identity to the reference polypeptide sequence. For example, VH1 comprises the amino acid sequence of SEQ ID NO:21; VH2 comprises the amino acid sequence of SEQ ID NO:20; VH3 comprises the amino acid sequence of SEQ ID NO:22; VL1 comprises the amino acid sequence of SEQ ID NO:26; VL2 comprises the amino acid sequence of SEQ ID NO:25; and VL3 comprises the amino acid sequence of SEQ ID NO:27.

In some aspects, one or more of VH1, VH2, VH3, VH4, VH5 and VH6 comprises a CDR1 comprising the amino acid sequence of SEQ ID NO:64 or an amino acid sequence having at least 90% identity or at least 95% identity to SEQ ID NO:64; a CDR2 comprising the amino acid sequence of SEQ ID NO:65 or an amino acid sequence having at least 90% identity or at least 95% identity to SEQ ID NO:65; and/or a CDR3 comprising the amino acid sequence of SEQ ID NO:66 or an amino acid sequence having at least 90% identity or at least 95% identity to SEQ ID NO:66; and/or one or more of VL1, VL2, VL3, VL4, VL5 and VL6 comprises a CDR1 comprising the amino acid sequence of SEQ ID NO:67 or an amino acid sequence having at least 90% identity or at least 95% identity to SEQ ID NO:67; a CDR2 comprising an amino acid sequence of SEQ ID NO:68 or an amino acid sequence having at least 90% identity or 95% identity to SEQ ID NO:68; and/or a CDR3 comprising the amino acid sequence of SEQ ID NO:69 or an amino acid sequence having at least 90% identity or at least 95% identity to SEQ ID NO:69. For example, one or more of VH1, VH2, VH3, VH4, VH5 and VH6 may comprise a CDR1 comprising an amino acid sequence having at least 90% identity to SEQ ID NO:64; a CDR2 comprising an amino acid sequence having at least 90% identity to SEQ ID NO:65; and/or a CDR3 comprising an amino acid sequence having at least 90% identity to SEQ ID NO:66. For example, one or more of VL1, VL2, VL3, VL4, VL5 and VL6 may comprise a CDR1 comprising an amino acid sequence having at least 90% identity to SEQ ID NO:67; a CDR2 comprising an amino acid sequence having at least 90% identity to SEQ ID NO:68; and/or a CDR3 comprising an amino acid sequence having at least 90% identity to SEQ ID NO:69. At least 90% identity may include at least 91%, 92%, 93%, 94%, 95%, 96%, 97%, 98%, 99% or 100% identity to the reference polypeptide sequence. For example, one or more of VH1, VH2, VH3, VH4, VH5 and VH6 may comprise a CDR1 comprising the amino acid sequence of SEQ ID NO:64; a CDR2 comprising the amino acid sequence of SEQ ID NO:65; and/or a CDR3 comprising the amino acid sequence of SEQ ID NO:66. For example, one or more of VL1, VL2, VL3, VL4, VL5 and VL6 may comprise a CDR1 comprising the amino acid sequence of SEQ ID NO:67; a CDR2 comprising the amino acid sequence of SEQ ID NO:68; and/or a CDR3 comprising the amino acid sequence of SEQ ID NO:69.

In some aspects, one or more of VH1, VH2, VH3, VH4, VH5 and VH6 comprises a CDR1 comprising the amino acid sequence of SEQ ID NO:70 or an amino acid sequence having at least 90% identity or at least 95% identity to SEQ ID NO:70; a CDR2 comprising the amino acid sequence of SEQ ID NO:71 or an amino acid sequence having at least 90% identity or at least 95% identity to SEQ ID NO:71; and/or a CDR3 comprising the amino acid sequence of SEQ ID NO:72 or an amino acid sequence having at least 90% identity or at least 95% identity to SEQ ID NO:72; and/or one or more of VL1, VL2, VL3, VL4, VL5 and VL6 comprises a CDR1 comprising the amino acid sequence of SEQ ID NO:73 or an amino acid sequence having at least 90% identity or at least 95% identity to SEQ ID NO:73; a CDR2 comprising an amino acid sequence of SEQ ID NO:74 or an amino acid sequence having at least 90% identity or 95% identity to SEQ ID NO:74; and/or a CDR3 comprising the amino acid sequence of SEQ ID NO:75 or an amino acid sequence having at least 90% identity or at least 95% identity to SEQ ID NO:75. For example, one or more of VH1, VH2, VH3, VH4, VH5 and VH6 may comprise a CDR1 comprising an amino acid sequence having at least 90% identity to SEQ ID NO:70; a CDR2 comprising an amino acid sequence having at least 90% identity to SEQ ID NO:71; and/or a CDR3 comprising an amino acid sequence having at least 90% identity to SEQ ID NO:72. For example, one or more of VL1, VL2, VL3, VL4, VL5 and VL6 may comprise a CDR1 comprising an amino acid sequence having at least 90% identity to SEQ ID NO:73; a CDR2 comprising an amino acid sequence having at least 90% identity to SEQ ID NO:74; and/or a CDR3 comprising an amino acid sequence having at least 90% identity to SEQ ID NO:75. At least 90% identity may include at least 91%, 92%, 93%, 94%, 95%, 96%, 97%, 98%, 99% or 100% identity to the reference polypeptide sequence. For example, one or more of VH1, VH2, VH3, VH4, VH5 and VH6 may comprise a CDR1 comprising the amino acid sequence having of SEQ ID NO:70; a CDR2 comprising the amino acid sequence of SEQ ID NO:71; and/or a CDR3 comprising the amino acid sequence of SEQ ID NO:72. For example, one or more of VL1, VL2, VL3, VL4, VL5 and VL6 may comprise a CDR1 comprising the amino acid sequence of SEQ ID NO:73; a CDR2 comprising the amino acid sequence of SEQ ID NO:74; and/or a CDR3 comprising the amino acid sequence of SEQ ID NO:75.

In some aspects, one or more of VH1, VH2, VH3, VH4, VH5 and VH6 comprises a CDR1 comprising the amino acid sequence of SEQ ID NO:76 or an amino acid sequence having at least 90% identity or at least 95% identity to SEQ ID NO:76; a CDR2 comprising the amino acid sequence of SEQ ID NO:77 or an amino acid sequence having at least 90% identity or at least 95% identity to SEQ ID NO:77; and/or a CDR3 comprising the amino acid sequence of SEQ ID NO:78 or an amino acid sequence having at least 90% identity or at least 95% identity to SEQ ID NO:78; and/or one or more of VL1, VL2, VL3, VL4, VL5 and VL6 comprises a CDR1 comprising the amino acid sequence of SEQ ID NO:79 or an amino acid sequence having at least 90% identity or at least 95% identity to SEQ ID NO:79; a CDR2 comprising an amino acid sequence of SEQ ID NO:80 or an amino acid sequence having at least 90% identity or 95% identity to SEQ ID NO:80; and/or a CDR3 comprising the amino acid sequence of SEQ ID NO:81 or an amino acid sequence having at least 90% identity or at least 95% identity to SEQ ID NO:81. For example, one or more of VH1, VH2, VH3, VH4, VH5 and VH6 may comprise a CDR1 comprising an amino acid sequence having at least 90% identity to SEQ ID NO:76; a CDR2 comprising an amino acid sequence having at least 90% identity to SEQ ID NO:77; and/or a CDR3 comprising an amino acid sequence having at least 90% identity to SEQ ID NO:78. For example, one or more of VL1, VL2, VL3, VL4, VL5 and VL6 may comprise a CDR1 comprising an amino acid sequence having at least 90% identity to SEQ ID NO:79; a CDR2 comprising an amino acid sequence having at least 90% identity to SEQ ID NO:80; and/or a CDR3 comprising an amino acid sequence having at least 90% identity to SEQ ID NO:81. At least 90% identity may include at least 91%, 92%, 93%, 94%, 95%, 96%, 97%, 98%, 99% or 100% identity to the reference polypeptide sequence. For example, one or more of VH1, VH2, VH3, VH4, VH5 and VH6 may comprise a CDR1 comprising the amino acid sequence of SEQ ID NO:76; a CDR2 comprising the amino acid sequence of SEQ ID NO:77; and/or a CDR3 comprising the amino acid sequence of SEQ ID NO:78. For example, one or more of VL1, VL2, VL3, VL4, VL5 and VL6 may comprise a CDR1 comprising the amino acid sequence of SEQ ID NO:79; a CDR2 comprising the amino acid sequence of SEQ ID NO:80; and/or a CDR3 comprising the amino acid sequence of SEQ ID NO:81.

In some aspects, one or more of VH1, VH2, VH3, VH4, VH5 and VH6 comprises a CDR1 comprising the amino acid sequence of SEQ ID NO:82 or an amino acid sequence having at least 90% identity or at least 95% identity to SEQ ID NO:82; a CDR2 comprising the amino acid sequence of SEQ ID NO:83 or an amino acid sequence having at least 90% identity or at least 95% identity to SEQ ID NO:83; and/or a CDR3 comprising the amino acid sequence of SEQ ID NO:84 or an amino acid sequence having at least 90% identity or at least 95% identity to SEQ ID NO:84; and/or one or more of VL1, VL2, VL3, VL4, VL5 and VL6 comprises a CDR1 comprising the amino acid sequence of SEQ ID NO:85 or an amino acid sequence having at least 90% identity or at least 95% identity to SEQ ID NO:85; a CDR2 comprising an amino acid sequence of SEQ ID NO:86 or an amino acid sequence having at least 90% identity or 95% identity to SEQ ID NO:86; and/or a CDR3 comprising the amino acid sequence of SEQ ID NO:87 or an amino acid sequence having at least 90% identity or at least 95% identity to SEQ ID NO:87. For example, one or more of VH1, VH2, VH3, VH4, VH5 and VH6 may comprise a CDR1 comprising an amino acid sequence having at least 90% identity to SEQ ID NO:82; a CDR2 comprising an amino acid sequence having at least 90% identity to SEQ ID NO:83; and/or a CDR3 comprising an amino acid sequence having at least 90% identity to SEQ ID NO:84. For example, one or more of VL1, VL2, VL3, VL4, VL5 and VL6 may comprise a CDR1 comprising an amino acid sequence having at least 90% identity to SEQ ID NO:85; a CDR2 comprising an amino acid sequence having at least 90% identity to SEQ ID NO:86; and/or a CDR3 comprising an amino acid sequence having at least 90% identity to SEQ ID NO:87. At least 90% identity may include at least 91%, 92%, 93%, 94%, 95%, 96%, 97%, 98%, 99% or 100% identity to the reference polypeptide sequence. For example, one or more of VH1, VH2, VH3, VH4, VH5 and VH6 may comprise a CDR1 comprising the amino acid sequence of SEQ ID NO:82; a CDR2 comprising the amino acid sequence of SEQ ID NO:83; and/or a CDR3 comprising the amino acid sequence of SEQ ID NO:84. For example, one or more of VL1, VL2, VL3, VL4, VL5 and VL6 may comprise a CDR1 comprising the amino acid sequence of SEQ ID NO:85; a CDR2 comprising the amino acid sequence of SEQ ID NO:86; and/or a CDR3 comprising the amino acid sequence of SEQ ID NO:87.

In some aspects, one or more of VH1, VH2, VH3, VH4, VH5 and VH6 comprises a CDR1 comprising the amino acid sequence of SEQ ID NO:88 or an amino acid sequence having at least 90% identity or at least 95% identity to SEQ ID NO:88; a CDR2 comprising the amino acid sequence of SEQ ID NO:89 or an amino acid sequence having at least 90% identity or at least 95% identity to SEQ ID NO:89; and/or a CDR3 comprising the amino acid sequence of SEQ ID NO:90 or an amino acid sequence having at least 90% identity or at least 95% identity to SEQ ID NO:90; and/or one or more of VL1, VL2, VL3, VL4, VL5 and VL6 comprises a CDR1 comprising the amino acid sequence of SEQ ID NO:91 or an amino acid sequence having at least 90% identity or at least 95% identity to SEQ ID NO:91; a CDR2 comprising an amino acid sequence of SEQ ID NO:92 or an amino acid sequence having at least 90% identity or 95% identity to SEQ ID NO:92; and/or a CDR3 comprising the amino acid sequence of SEQ ID NO:93 or an amino acid sequence having at least 90% identity or at least 95% identity to SEQ ID NO:93. For example, one or more of VH1, VH2, VH3, VH4, VH5 and VH6 may comprise a CDR1 comprising an amino acid sequence having at least 90% identity to SEQ ID NO:88; a CDR2 comprising an amino acid sequence having at least 90% to SEQ ID NO:89; and/or a CDR3 comprising an amino acid sequence having at least 90% identity to SEQ ID NO:90. For example, one or more of VL1, VL2, VL3, VL4, VL5 and VL6 may comprise a CDR1 comprising an amino acid sequence having at least 90% identity to SEQ ID NO:91; a CDR2 comprising an amino acid sequence having at least 90% identity to SEQ ID NO:92; and/or a CDR3 comprising an amino acid sequence having at least 90% identity to SEQ ID NO:93. At least 90% identity may include at least 91%, 92%, 93%, 94%, 95%, 96%, 97%, 98%, 99% or 100% identity to the reference polypeptide sequence. For example, one or more of VH1, VH2, VH3, VH4, VH5 and VH6 may comprise a CDR1 comprising the amino acid sequence of SEQ ID NO:88; a CDR2 comprising the amino acid sequence of SEQ ID NO:89; and/or a CDR3 comprising the amino acid sequence of SEQ ID NO:90. For example, one or more of VL1, VL2, VL3, VL4, VL5 and VL6 may comprise a CDR1 comprising the amino acid sequence of SEQ ID NO:91; a CDR2 comprising the amino acid sequence of SEQ ID NO:92; and/or a CDR3 comprising the amino acid sequence of SEQ ID NO:93.

In yet other aspects, an antigen binding polypeptide or antigen binding polypeptide complex of the invention comprises a polypeptide having a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; wherein VL1 is a first immunoglobulin light chain variable region that comprises an amino acid sequence having at least 90% identity, at least 95% identity, or 100% identity to any one of SEQ ID NO:25-29; VL2 is a second immunoglobulin light chain variable region that comprises an amino acid sequence having at least 90% identity, at least 95% identity, or 100% identity to any one of SEQ ID NO:25-29; VL3 is a third immunoglobulin light chain variable region that comprises an amino acid sequence having at least 90% identity, at least 95% identity, or 100% identity to any one of SEQ ID NO:25-29; VH1 is a first immunoglobulin heavy chain variable region that comprises an amino acid sequence having at least 90% identity, at least 95% identity, or 100% identity to any one of SEQ ID NO:20-24; VH2 is a second immunoglobulin heavy chain variable region that comprises an amino acid sequence having at least 90% identity, at least 95% identity, or 100% identity to any one of SEQ ID NO:20-24; VH3 is a third immunoglobulin heavy chain variable region that comprises an amino acid sequence having at least 90% identity, at least 95% identity, or 100% identity to any one of SEQ ID NO:20-24; and L1, L2, L3, L4 and L5 are amino acid linkers. For example, the VL1 may comprises an amino acid sequence having at least 90% identity to any one of SEQ ID NO:25-29; VL2 may comprises an amino acid sequence having at least 90% identity to any one of SEQ ID NO:25-29; VL3 may comprise an amino acid sequence having at least 90% identity to any one of SEQ ID NO:25-29; VH1 may comprise an amino acid sequence having at least 90% identity to any one of SEQ ID NO:20-24; VH2 may comprise an amino acid sequence having at least 90% identity to any one of SEQ ID NO:20-24; and/or VH3 may comprise an amino acid sequence having at least 90% identity to any one of SEQ ID NO:20-24. At least 90% identity may include at least 91%, 92%, 93%, 94%, 95%, 96%, 97%, 98%, 99% or 100% identity to the reference polypeptide sequence. For example, the VL1 may comprise the amino acid sequence of any one of SEQ ID NO:25-29; VL2 may comprise the amino acid sequence of any one of SEQ ID NO:25-29; VL3 may comprise the amino acid sequence of any one of SEQ ID NO:25-29; VH1 may comprise the amino acid sequence of any one of SEQ ID NO:20-24; VH2 may comprise the amino acid sequence of any one of SEQ ID NO:20-24; and/or VH3 may comprise the amino acid sequence of any one of SEQ ID NO:20-24.

In some aspects, the antigen binding polypeptide and antigen binding polypeptide complex of the invention specifically bind to an HIV protein. The HIV protein specifically bound by the antigen binding polypeptide and antigen binding polypeptide complex of the invention may be selected from: Env, gp160, gp120, gp41, p17, p24, p7, p55, p66, p31, Nef, Tat, Rev, Vif, Vpr and Vpu. In some aspects, the antigen binding polypeptide or antigen binding polypeptide complex specifically binds at least one epitope on at least HIV protein selected from: Env, gp160, gp120, gp41, p17, p24, p7, p55, p66, p31, Nef, Tat, Rev, Vif, Vpr and Vpu. In some aspects, the antigen binding polypeptide or polypeptide comprised within the antigen binding complex may comprise a VL1, VL2, VL3, VL4, VL5, VL6, VH1, VH2, VH3, VH4, VH5 and/or VH6 that specifically binds to one or more of: Env, gp160, gp120, gp41, p17, p24, p7, p55, p66, p31, Nef, Tat, Rev, Vif, Vpr and Vpu. For example, the antigen binding polypeptide or polypeptide comprised within the antigen binding complex may comprise a VL1 that specifically binds to Env, gp160, gp120, gp41, p17, p24, p7, p55, p66, p31, Nef, Tat, Rev, Vif, Vpr and Vpu. For example, the VL1 may specifically bind to Env. For example, the VL1 may specifically bind to gp160. For example, the VL1 may specifically bind to gp120. For example, the VL1 may specifically bind to gp41. For example, the VL1 may specifically bind to p17. For example, the VL1 may specifically bind to p24. For example, the VL1 may specifically bind to p7. For example, the VL1 may specifically bind to p55. For example, the VL1 may specifically bind to p66. For example, the VL1 may specifically bind to p31. For example, the VL1 may specifically bind to Nef. For example, the VL1 may specifically bind to Tat. For example, the VL1 may specifically bind to Rev. For example, the VL1 may specifically bind to Vif. For example, the VL1 may specifically bind to Vpr. or example, the VL1 may specifically bind to Vpu. For example, the antigen binding polypeptide or polypeptide comprised within the antigen binding complex may comprise a VL2 that specifically binds to Env, gp160, gp120, gp41, p17, p24, p7, p55, p66, p31, Nef, Tat, Rev, Vif, Vpr and Vpu. For example, the VL2 may specifically bind to Env. For example, the VL2 may specifically bind to gp160. For example, the VL2 may specifically bind to gp120. For example, the VL2 may specifically bind to gp41. For example, the VL2 may specifically bind to p17. For example, the VL2 may specifically bind to p24. For example, the VL2 may specifically bind to p7. For example, the VL2 may specifically bind to p55. For example, the VL2 may specifically bind to p66. For example, the VL2 may specifically bind to p31. For example, the VL2 may specifically bind to Nef. For example, the VL2 may specifically bind to Tat. For example, the VL2 may specifically bind to Rev. For example, the VL2 may specifically bind to Vif. For example, the VL2 may specifically bind to Vpr. or example, the VL2 may specifically bind to Vpu. For example, the antigen binding polypeptide or polypeptide comprised within the antigen binding complex may comprise a VL3 that specifically binds to Env, gp160, gp120, gp41, p17, p24, p7, p55, p66, p31, Nef, Tat, Rev, Vif, Vpr and Vpu. For example, the VL3 may specifically bind to Env. For example, the VL3 may specifically bind to gp160. For example, the VL3 may specifically bind to gp120. For example, the VL3 may specifically bind to gp41. For example, the VL3 may specifically bind to p17. For example, the VL3 may specifically bind to p24. For example, the VL3 may specifically bind to p7. For example, the VL3 may specifically bind to p55. For example, the VL3 may specifically bind to p66. For example, the VL3 may specifically bind to p31. For example, the VL3 may specifically bind to Nef. For example, the VL3 may specifically bind to Tat. For example, the VL3 may specifically bind to Rev. For example, the VL3 may specifically bind to Vif. For example, the VL3 may specifically bind to Vpr. or example, the VL3 may specifically bind to Vpu. For example, the antigen binding polypeptide or polypeptide comprised within the antigen binding complex may comprise a VL4 that specifically binds to Env, gp160, gp120, gp41, p17, p24, p7, p55, p66, p31, Nef, Tat, Rev, Vif, Vpr and Vpu. For example, the VL4 may specifically bind to Env. For example, the VL4 may specifically bind to gp160. For example, the VL4 may specifically bind to gp120. For example, the VL4 may specifically bind to gp41. For example, the VL4 may specifically bind to p17. For example, the VL4 may specifically bind to p24. For example, the VL4 may specifically bind to p7. For example, the VL4 may specifically bind to p55. For example, the VL4 may specifically bind to p66. For example, the VL4 may specifically bind to p31. For example, the VL4 may specifically bind to Nef. For example, the VL4 may specifically bind to Tat. For example, the VL4 may specifically bind to Rev. For example, the VL4 may specifically bind to Vif. For example, the VL4 may specifically bind to Vpr. or example, the VL4 may specifically bind to Vpu. For example, the antigen binding polypeptide or polypeptide comprised within the antigen binding complex may comprise a VL5 that specifically binds to Env, gp160, gp120, gp41, p17, p24, p7, p55, p66, p31, Nef, Tat, Rev, Vif, Vpr and Vpu. For example, the VL5 may specifically bind to Env. For example, the VL5 may specifically bind to gp160. For example, the VL5 may specifically bind to gp120. For example, the VL5 may specifically bind to gp41. For example, the VL5 may specifically bind to p17. For example, the VL5 may specifically bind to p24. For example, the VL5 may specifically bind to p7. For example, the VL5 may specifically bind to p55. For example, the VL5 may specifically bind to p66. For example, the VL5 may specifically bind to p31. For example, the VL5 may specifically bind to Nef. For example, the VL5 may specifically bind to Tat. For example, the VL5 may specifically bind to Rev. For example, the VL5 may specifically bind to Vif. For example, the VL5 may specifically bind to Vpr. or example, the VL5 may specifically bind to Vpu. For example, the antigen binding polypeptide or polypeptide comprised within the antigen binding complex may comprise a VL6 that specifically binds to Env, gp160, gp120, gp41, p17, p24, p7, p55, p66, p31, Nef, Tat, Rev, Vif, Vpr and Vpu. For example, the VL6 may specifically bind to Env. For example, the VL6 may specifically bind to gp160. For example, the VL6 may specifically bind to gp120. For example, the VL6 may specifically bind to gp41. For example, the VL6 may specifically bind to p17. For example, the VL6 may specifically bind to p24. For example, the VL6 may specifically bind to p7. For example, the VL6 may specifically bind to p55. For example, the VL6 may specifically bind to p66. For example, the VL6 may specifically bind to p31. For example, the VL6 may specifically bind to Nef. For example, the VL6 may specifically bind to Tat. For example, the VL6 may specifically bind to Rev. For example, the VL6 may specifically bind to Vif. For example, the VL6 may specifically bind to Vpr. or example, the VL6 may specifically bind to Vpu. For example, the antigen binding polypeptide or polypeptide comprised within the antigen binding complex may comprise a VH1 that specifically binds to Env, gp160, gp120, gp41, p17, p24, p7, p55, p66, p31, Nef, Tat, Rev, Vif, Vpr and Vpu. For example, the VH1 may specifically bind to Env. For example, the VH1 may specifically bind to gp160. For example, the VH1 may specifically bind to gp120. For example, the VH1 may specifically bind to gp41. For example, the VH1 may specifically bind to p17. For example, the VH1 may specifically bind to p24. For example, the VH1 may specifically bind to p7. For example, the VH1 may specifically bind to p55. For example, the VH1 may specifically bind to p66. For example, the VH1 may specifically bind to p31. For example, the VH1 may specifically bind to Nef. For example, the VH1 may specifically bind to Tat. For example, the VH1 may specifically bind to Rev. For example, the VH1 may specifically bind to Vif. For example, the VH1 may specifically bind to Vpr. or example, the VH1 may specifically bind to Vpu. For example, the antigen binding polypeptide or polypeptide comprised within the antigen binding complex may comprise a VH2 that specifically binds to Env, gp160, gp120, gp41, p17, p24, p7, p55, p66, p31, Nef, Tat, Rev, Vif, Vpr and Vpu. For example, the VH2 may specifically bind to Env. For example, the VH2 may specifically bind to gp160. For example, the VH2 may specifically bind to gp120. For example, the VH2 may specifically bind to gp41. For example, the VH2 may specifically bind to p17. For example, the VH2 may specifically bind to p24. For example, the VH2 may specifically bind to p7. For example, the VH2 may specifically bind to p55. For example, the VH2 may specifically bind to p66. For example, the VH2 may specifically bind to p31. For example, the VH2 may specifically bind to Nef. For example, the VH2 may specifically bind to Tat. For example, the VH2 may specifically bind to Rev. For example, the VH2 may specifically bind to Vif. For example, the VH2 may specifically bind to Vpr. or example, the VH2 may specifically bind to Vpu. For example, the antigen binding polypeptide or polypeptide comprised within the antigen binding complex may comprise a VH3 that specifically binds to Env, gp160, gp120, gp41, p17, p24, p7, p55, p66, p31, Nef, Tat, Rev, Vif, Vpr and Vpu. For example, the VH3 may specifically bind to Env. For example, the VH3 may specifically bind to gp160. For example, the VH3 may specifically bind to gp120. For example, the VH3 may specifically bind to gp41. For example, the VH3 may specifically bind to p17. For example, the VH3 may specifically bind to p24. For example, the VH3 may specifically bind to p7. For example, the VH3 may specifically bind to p55. For example, the VH3 may specifically bind to p66. For example, the VH3 may specifically bind to p31. For example, the VH3 may specifically bind to Nef. For example, the VH3 may specifically bind to Tat. For example, the VH3 may specifically bind to Rev. For example, the VH3 may specifically bind to Vif. For example, the VH3 may specifically bind to Vpr. or example, the VH3 may specifically bind to Vpu. For example, the antigen binding polypeptide or polypeptide comprised within the antigen binding complex may comprise a VH4 that specifically binds to Env, gp160, gp120, gp41, p17, p24, p7, p55, p66, p31, Nef, Tat, Rev, Vif, Vpr and Vpu. For example, the VH4 may specifically bind to Env. For example, the VH4 may specifically bind to gp160. For example, the VH4 may specifically bind to gp120. For example, the VH4 may specifically bind to gp41. For example, the VH4 may specifically bind to p17. For example, the VH4 may specifically bind to p24. For example, the VH4 may specifically bind to p7. For example, the VH4 may specifically bind to p55. For example, the VH4 may specifically bind to p66. For example, the VH4 may specifically bind to p31. For example, the VH4 may specifically bind to Nef. For example, the VH4 may specifically bind to Tat. For example, the VH4 may specifically bind to Rev. For example, the VH4 may specifically bind to Vif. For example, the VH4 may specifically bind to Vpr. or example, the VH4 may specifically bind to Vpu. For example, the antigen binding polypeptide or polypeptide comprised within the antigen binding complex may comprise a VH5 that specifically binds to Env, gp160, gp120, gp41, p17, p24, p7, p55, p66, p31, Nef, Tat, Rev, Vif, Vpr and Vpu. For example, the VH5 may specifically bind to Env. For example, the VH5 may specifically bind to gp160. For example, the VH5 may specifically bind to gp120. For example, the VH5 may specifically bind to gp41. For example, the VH5 may specifically bind to p17. For example, the VH5 may specifically bind to p24. For example, the VH5 may specifically bind to p7. For example, the VH5 may specifically bind to p55. For example, the VH5 may specifically bind to p66. For example, the VH5 may specifically bind to p31. For example, the VH5 may specifically bind to Nef. For example, the VH5 may specifically bind to Tat. For example, the VH5 may specifically bind to Rev. For example, the VH5 may specifically bind to Vif. For example, the VH5 may specifically bind to Vpr. or example, the VH5 may specifically bind to Vpu. For example, the antigen binding polypeptide or polypeptide comprised within the antigen binding complex may comprise a VH6 that specifically binds to Env, gp160, gp120, gp41, p17, p24, p7, p55, p66, p31, Nef, Tat, Rev, Vif, Vpr and Vpu. For example, the VH6 may specifically bind to Env. For example, the VH6 may specifically bind to gp160. For example, the VH6 may specifically bind to gp120. For example, the VH6 may specifically bind to gp41. For example, the VH6 may specifically bind to p17. For example, the VH6 may specifically bind to p24. For example, the VH6 may specifically bind to p7. For example, the VH6 may specifically bind to p55. For example, the VH6 may specifically bind to p66. For example, the VH6 may specifically bind to p31. For example, the VH6 may specifically bind to Nef. For example, the VH6 may specifically bind to Tat. For example, the VH6 may specifically bind to Rev. For example, the VH6 may specifically bind to Vif. For example, the VH6 may specifically bind to Vpr. or example, the VH6 may specifically bind to Vpu. Any of the antigen binding polypeptide structures and any of the antigen binding polypeptide complex structures described herein may be used to target one or more of the HIV proteins described herein.

In other aspects, the invention is directed to antigen binding polypeptides and antigen binding polypeptide complexes comprising a polypeptide having a structure represented by VH3-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; or VH1-VL2-VL3-VH3-VH2-VL1, wherein the antigen binding polypeptides or antigen binding polypeptide complexes specifically bind to an HIV protein. In some aspects, the antigen binding polypeptide or antigen binding polypeptide complex contains an amino acid linker between any two regions denoted in a structure described herein. In some aspects, the antigen binding polypeptide or antigen binding polypeptide complex can contain an Fc region, CH1 region, CL region, CH3 region or any combination thereof. In some aspects, the Fc region, CH1 region, CL region and/or CH3 is located at the carboxy terminus of the antigen binding polypeptide, and is optionally linked to polypeptide by at least one amino acid linker. Examples of an Fc region include, but are not limited to, an amino acid sequence of any one of SEQ ID NOs:389-402, or an amino acid sequence having at least 80%, at least 85%, at least 90%, at least 95%, at least 96%, at least 97%, at least 98%, or at least 99% identity to any one of SEQ ID NOs:389-402. Examples of a CH1 region include, but are not limited to, an amino acid sequence of any one of SEQ ID NOs:403-407, or an amino acid sequence having at least 80%, at least 85%, at least 90%, at least 95%, at least 96%, at least 97%, at least 98%, or at least 99% identity to any one of SEQ ID NOs:403-407. Examples of a CL region include, but are not limited to, an amino acid sequence of SEQ ID NO:418 or 419, or an amino acid sequence having at least 80%, at least 85%, at least 90%, at least 95%, at least 96%, at least 97%, at least 98%, or at least 99% identity to SEQ ID NO:418 or 419. In some aspects, the antigen binding polypeptide complex is an antibody or antigen binding fragment thereof.

In some aspects, an antigen binding polypeptide of antigen binding polypeptide complex of the invention comprises a polypeptide having a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; wherein VL1 is a first immunoglobulin light chain variable region that specifically binds to an HIV protein; VL2 is a second immunoglobulin light chain variable region that specifically binds to an HIV protein; VL3 is a third immunoglobulin light chain variable region that specifically binds to an HIV protein; VH1 is a first immunoglobulin heavy chain variable region that specifically binds to an HIV protein; VH2 is a second immunoglobulin heavy chain variable region that specifically binds to an HIV protein; VH3 is a third immunoglobulin heavy chain variable region that specifically binds to an HIV protein; and L1, L2, L3, L4 and L5 are amino acid linkers.

In some aspects, the antigen binding polypeptide complex comprises a first polypeptide and a second polypeptide; wherein the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; or VH1-L1-VL2-L2-VL3-L3-VH3-L4-VH2-L5-VL1; wherein the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VH5-VL4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-

VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1 is a first immunoglobulin light chain variable region that specifically binds to an HIV protein; VL2 is a second immunoglobulin light chain variable region that specifically binds to an HIV protein; VL3 is a third immunoglobulin light chain variable region that specifically binds to an HIV protein; VL4 is a fourth immunoglobulin light chain variable region that specifically binds to an HIV protein; VL5 is a fifth immunoglobulin light chain variable region that specifically binds to an HIV protein; VL6 is a sixth immunoglobulin light chain variable region that specifically binds to an HIV protein; VH1 is a first immunoglobulin heavy chain variable region that specifically binds to an HIV protein; VH2 is a second immunoglobulin heavy chain variable region that specifically binds to an HIV protein; VH3 is a third immunoglobulin heavy chain variable region that specifically binds to an HIV protein; VH4 is a fourth immunoglobulin heavy chain variable region that specifically binds to an HIV protein; VH5 is a fifth immunoglobulin heavy chain variable region that specifically binds to an HIV protein; VH6 is a sixth immunoglobulin heavy chain variable region that specifically binds to an HIV protein; and L1, L2, L3, L4, L5, L6, L7, L8, L9 and L10 are amino acid linkers. In some aspects, the first polypeptide has a structure represented by VL1-VL2-VL3-VH3-VH2-VH1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; or VH4-L6-VL5-L7-VL6-L8-VH6-L9-VH5-L10-VL4; wherein VL1, VL2, VL3, VL4, VL5, VL6, VH1, VH2, VH3, VH4, VH5 and/or VH6 specifically binds to an HIV protein. In some aspects, the first polypeptide has a structure represented by VH1-VH2-VH3-VL3-VL2-VL1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; or VH4-L6-VL5-L7-VL6-L8-VH6-L9-VH5-L10-VL4; wherein VL1, VL2, VL3, VL4, VL5, VL6, VH1, VH2, VH3, VH4, VH5 and/or VH6 specifically binds to an HIV protein. In some aspects, the first polypeptide has a structure represented by VH1-VH2-VH3-VH3-VL2-VL1; and the second polypeptide has a structure represented by VL4-VH4; VH4-VL4; VL4-L6-VH4; VH4-L6-

VH1, VH2, VH3, VH4, VH5 and/or VH6 specifically binds to an HIV protein. In some aspects, the first polypeptide has a structure represented by VL1-VH2-VL3-VH3-VL2-VH1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1, VL2, VL3, VL4, VL5, VL6, VH1, VH2, VH3, VH4, VH5 and/or VH6 specifically binds to an HIV protein. In some aspects, the first polypeptide has a structure represented by VH1-VL2-VH3-VL3-VH2-VL1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; or VH4-L6-VL5-L7-VL6-L8-VH6-L9-VH5-L10-VL4; wherein VL1, VL2, VL3, VL4, VL5, VL6, VH1, VH2, VH3, VH4, VH5 and/or VH6 specifically binds to an HIV protein. In some aspects, the first polypeptide has a structure represented by VH1-VH2-VL3-VH3-VL2-VL1; and the second polypeptide has a structure represented by VL4-VH4; VH4-VL4; VL4-L6-VH4; VH4-L6-

VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1, VL2, VL3, VL4, VL5, VL6, VH1, VH2, VH3, VH4, VH5 and/or VH6 specifically binds to an HIV protein. In some aspects, the first polypeptide has a structure represented by VH1-VL2-VH3-VL3-VL2-VH1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1, VL2, VL3, VL4, VL5, VL6, VH1, VH2, VH3, VH4, VH5 and/or VH6 specifically binds to an HIV protein. In some aspects, the first polypeptide has a structure represented by VH1-VL2-VL3-VH3-VH2-VL1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1, VL2, VL3, VL4, VL5, VL6, VH1, VH2, VH3, VH4, VH5 and/or VH6 specifically binds to an HIV protein. In some aspects, the first polypeptide has a structure represented by VL1-L1-VL2-L2-VL3-L3-VH3-L4-VH2-L5-VH1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-

VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1, VL2, VL3, VL4, VL5, VL6, VH1, VH2, VH3, VH4, VH5 and/or VH6 specifically binds to an HIV protein. In some aspects, the first polypeptide has a structure represented by VH1-L1-VH2-L2-VH3-L3-VL3-L4-VL2-L5-VL1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1, VL2, VL3, VL4, VL5, VL6, VH1, VH2, VH3, VH4, VH5 and/or VH6 specifically binds to an HIV protein. In some aspects, the first polypeptide has a structure represented by VL1-L1-VH2-L2-VL3-L3-VH3-L4-VL2-L5-VH1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1, VL2, VL3, VL4, VL5, VL6, VH1, VH2, VH3, VH4, VH5 and/or VH6 specifically binds to an HIV protein. In some aspects, the first polypeptide has a structure represented by VH1-L1-VL2-L2-VH3-L3-VL3-L4-VH2-L5-VL1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-

L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1, VL2, VL3, VL4, VL5, VL6, VH1, VH2, VH3, VH4, VH5 and/or VH6 specifically binds to an HIV protein. In some aspects, the first polypeptide has a structure represented by VL1-L1-VL2-L2-VH3-L3-VL3-L4-VH2-L5-VH1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1, VL2, VL3, VL4, VL5, VL6, VH1, VH2, VH3, VH4, VH5 and/or VH6 specifically binds to an HIV protein. In some aspects, the first polypeptide has a structure represented by VH1-L1-VH2-L2-VL3-L3-VH3-L4-VL2-L5-VL1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1, VL2, VL3, VL4, VL5, VL6, VH1, VH2, VH3, VH4, VH5 and/or VH6 specifically binds to an HIV protein.

VH6-L9-VH5-L10-VL4; wherein VL1, VL2, VL3, VL4, VL5, VL6, VH1, VH2, VH3, VH4, VH5 and/or VH6 specifically binds to an HIV protein. In some aspects, the first polypeptide has a structure represented by VH1-L1-VL2-L2-VL3-L3-VH3-L4-VH2-L5-VL1; and the second polypeptide has a structure represented by VL4-VH4; VH4-VL4; VL4-L6-VH4; VH4-L6-VL4; VL4-L6-VH4-L7; VH4-L6-VL4-L7; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VH4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1, VL2, VL3, VL4, VL5, VL6, VH1, VH2, VH3, VH4, VH5 and/or VH6 specifically binds to an HIV protein. For the avoidance of doubt, all the antigen binding polypeptide structures described herein can be combined with any one or more of the HIV targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VL4, VL5, VL6, VH1, VH2, VH3, VH4, VH5 and/or VH6 of each and every antigen binding polypeptide and antigen binding polypeptide complex described herein may independently bind to any one of said particularly preferred targets.

In some aspects, the antigen binding polypeptide or antigen binding polypeptide complex comprises a polypeptide having a structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; VH1-VL2-VL3-VH3-VH2-VL1-Fc; VL1-L1-VL2-L2-VL3-L3-VH3-L4-VH2-L5-VH1-Fc; VL1-L1-VL2-L2-VL3-L3-VH3-L4-VH2-L5-VH1-L6-Fc; VH1-L1-VH2-L2-VH3-L3-VL3-L4-VL2-L5-VL1-Fc; VH1-L1-VH2-L2-VH3-L3-VL3-L4-VL2-L5-VL1-L6-Fc; VL1-L1-VH2-L2-VL3-L3-VH3-L4-VL2-L5-VH1-Fc; VL1-L1-VH2-L2-VL3-L3-VH3-L4-VL2-L5-VH1-L6-Fc; VH1-L1-VL2-L2-VH3-L3-VL3-L4-VH2-L5-VL1-Fc; VH1-L1-VL2-L2-VH3-L3-VL3-L4-VH2-L5-VL1-L6-Fc; VL1-L1-VL2-L2-VH3-L3-VL3-L4-VH2-L5-VH1-Fc; VL1-L1-VL2-L2-VH3-L3-VL3-L4-VH2-L5-VH1-L6-Fc; VH1-L1-VH2-L2-VL3-L3-VH3-L4-VL2-L5-VL1-Fc; VH1-L1-VH2-L2-VL3-L3-VH3-L4-VL2-L5-VL1-L6-Fc; VL1-L1-VH2-L2-VH3-L3-VL3-L4-VL2-L5-VH1-Fc; VL1-L1-VH2-L2-VH3-L3-VL3-L4-VL2-L5-VH1-L6-Fc; VH1-L1-VL2-L2-VL3-L3-VH3-L4-VH2-L5-VL1-Fc; or VH1-L1-VL2-L2-VL3-L3-VH3-L4-VH2-L5-VL1-L6-Fc; wherein VL1 is a first immunoglobulin light chain variable region that specifically binds to an HIV protein; VL2 is a second immunoglobulin light chain variable region that specifically binds to an HIV protein; VL3 is a third immunoglobulin light chain variable region that specifically binds to an HIV protein; VH1 is a first immunoglobulin heavy chain variable region that specifically binds to an HIV protein; VH2 is a second immunoglobulin heavy chain variable region that specifically binds to an HIV protein; VH3 is a third immunoglobulin heavy chain variable region that specifically binds to an HIV protein; Fc is a region comprising an immunoglobulin heavy chain constant region 2 (CH2), an immunoglobulin heavy chain constant region 3 (CH3), and optionally, an immunoglobulin hinge; and L1, L2, L3, L4, L5 and L6 are amino acid linkers. In some aspects, the polypeptide has a structure represented by VL1-VL2-VL3-VH3-VH2-VH1-Fc; wherein VL1, VL2, VL3, VH1, VH2, and/or VH3 specifically binds to an HIV protein. In some aspects, the polypeptide has a structure represented by VH1-VH2-VH3-VL3-VL2-VL1-Fc; wherein VL1, VL2, VL3, VH1, VH2, and/or VH3 specifically binds to an HIV protein. In some aspects, the polypeptide has a structure represented by VL1-VH2-VL3-VH3-VL2-VH1-Fc; wherein VL1, VL2, VL3, VH1, VH2, and/or VH3 specifically binds to an HIV protein. In some aspects, the polypeptide has a structure represented by VH1-VL2-VH3-VL3-VH2-VL1-Fc; wherein VL1, VL2, VL3, VH1, VH2, and/or VH3 specifically binds to an HIV protein. In some aspects, the polypeptide has a structure represented by VL1-VL2-VH3-VL3-VH2-VH1-Fc; wherein VL1, VL2, VL3, VH1, VH2, and/or VH3 specifically binds to an HIV protein. In some aspects, the polypeptide has a structure represented by VH1-VH2-VL3-VH3-VL2-VL1-Fc; wherein VL1, VL2, VL3, VH1, VH2, and/or VH3 specifically binds to an HIV protein. In some aspects, the polypeptide has a structure represented by VL1-VH2-VH3-VL3-VL2-VH1-Fc; wherein VL1, VL2, VL3, VH1, VH2, and/or VH3 specifically binds to an HIV protein. In some aspects, the polypeptide has a structure represented by VH1-VL2-VL3-VH3-VH2-VL1-Fc; wherein VL1, VL2, VL3, VH1, VH2, and/or VH3 specifically binds to an HIV protein. In some aspects, the polypeptide has a structure represented by VL1-L1-VL2-L2-VL3-L3-VH3-L4-VH2-L5-VH1-L6-Fc; wherein VL1, VL2, VL3, VH1, VH2, and/or VH3 specifically binds to an HIV protein. In some aspects, the polypeptide has a structure represented by VH1-L1-VH2-L2-VH3-L3-VL3-L4-VL2-L5-VL1-Fc; wherein VL1, VL2, VL3, VH1, VH2, and/or VH3 specifically binds to an HIV protein. In some aspects, the polypeptide has a structure represented by VH1-L1-VH2-L2-VH3-L3-VL3-L4-VL2-L5-VL1-L6-Fc; wherein VL1, VL2, VL3, VH1, VH2, and/or VH3 specifically binds to an HIV protein. In some aspects, the polypeptide has a structure represented by VL1-L1-VH2-L2-VL3-L3-VH3-L4-VL2-L5-VH1-Fc; wherein VL1, VL2, VL3, VH1, VH2, and/or VH3 specifically binds to an HIV protein. In some aspects, the polypeptide has a structure represented by VL1-L1-VH2-L2-VL3-L3-VH3-L4-VL2-L5-VH1-L6-Fc; wherein VL1, VL2, VL3, VH1, VH2, and/or VH3 specifically binds to an HIV protein. In some aspects, the polypeptide has a structure represented by VH1-L1-VL2-L2-VH3-L3-VL3-L4-VH2-L5-VL1-Fc; wherein VL1, VL2, VL3, VH1, VH2, and/or VH3 specifically binds to an HIV protein. In some aspects, the polypeptide has a structure represented by VH1-L1-VL2-L2-VH3-L3-VL3-L4-VH2-L5-VL1-L6-Fc; wherein VL1, VL2, VL3, VH1, VH2, and/or VH3 specifically binds to an HIV protein. In some aspects, the polypeptide has a structure represented by VL1-L1-VL2-L2-VH3-L3-VL3-L4-VH2-L5-VH1-F c; wherein VL1, VL2, VL3, VH1, VH2, and/or VH3 specifically binds to an HIV protein. In some aspects, the polypeptide has a structure represented by VL1-L1-VL2-L2-VH3-L3-VL3-L4-VH2-L5-VH1-L6-Fc; wherein VL1, VL2, VL3, VH1, VH2, and/or VH3 specifically binds to an HIV protein. In some aspects, the polypeptide has a structure represented by VH1-L1-VH2-L2-VL3-L3-VH3-L4-VL2-L5-VL1-Fc; wherein VL1, VL2, VL3, VH1, VH2, and/or VH3 specifically binds to an HIV protein. In some aspects, the polypeptide has a structure represented by VH1-L1-VH2-L2-VL3-L3-VH3-L4-VL2-L5-VL1-L6-Fc; wherein VL1, VL2, VL3, VH1, VH2, and/or VH3 specifically binds to an HIV protein. In some aspects, the polypeptide has a structure represented by VL1-L1-VH2-L2-VH3-L3-VL3-L4-VL2-L5-VH1-Fc; wherein VL1, VL2, VL3, VH1, VH2, and/or VH3 specifically binds to an HIV protein. In some aspects, the polypeptide has a structure represented VL1-L1-VH2-L2-VH3-L3-VL3-L4-VL2-L5-VH1-L6-F c; wherein VL1, VL2, VL3, VH1, VH2, and/or VH3 specifically binds to an HIV protein. In some aspects, the polypeptide has a structure represented by VH1-L1-VL2-L2-VL3-L3-VH3-L4-VH2-L5-VL1-Fc; wherein VL1, VL2, VL3, VH1, VH2, and/or VH3 specifically binds to an HIV protein. In some aspects, the polypeptide has a structure represented by VH1-L1-VL2-L2-VL3-L3-VH3-L4-VH2-L5-VL1-L6-Fc; wherein VL1, VL2, VL3, VH1, VH2, and/or VH3 specifically binds to an HIV protein. For the avoidance of doubt, all the antigen binding polypeptide structures described herein can be combined with any one or more of the HIV targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VH1, VH2, and/or VH3 of each and every antigen binding polypeptide and antigen binding polypeptide complex described herein may independently bind to any one of said particularly preferred targets.

In some aspects, the antigen binding polypeptide or antigen binding polypeptide complex comprises a polypeptide having a structure represented by VL1-VL2-VL3-VH3-VH2-VH1-Fc-Fc; VH1-VH2-VH3-VL3-VL2-VL1-Fc-Fc; VL1-VH2-VL3-VH3-VL2-VL1-Fc-Fc; VH1-VL2-VH3-VL3-VH2-VL1-Fc-Fc; VL1-VL2-VH3-VL3-VH2-VH1-Fc-Fc; VH1-VH2-VL3-VH3-VL2-VL1-Fc-Fc; VL1-VH2-VH3-VL3-VL2-VH1-Fc-Fc; VH1-VL2-VL3-VH3-VH2-VL1-Fc-Fc; VL1-L1-VL2-L2-VL3-L3-VH3-L4-VH2-L5-VH1-Fc-Fc; VL1-L1-VL2-L2-VL3-L3-VH3-L4-VH2-L5-VH1-L6-Fc-Fc; VL1-L1-VL2-L2-VL3-L3-VH3-L4-VH2-L5-VH1-L6-Fc-L7-Fc; VH1-L1-VH2-L2-VH3-L3-VL3-L4-VL2-L5-VL1-Fc-Fc; VH1-L1-VH2-L2-VH3-L3-VL3-L4-VL2-L5-VL1-L6-Fc-Fc; VH1-L1-VH2-L2-VH3-L3-VL3-L4-VL2-L5-VL1-L6-Fc-L7-Fc; VL1-L1-VH2-L2-VL3-L3-VH3-L4-VL2-L5-VH1-Fc-Fc; VL1-L1-VH2-L2-VL3-L3-VH3-L4-VL2-L5-VH1-L6-Fc-Fc; VL1-L1-VH2-L2-VL3-L3-VH3-L4-VL2-L5-VH1-L6-Fc-L7-Fc; VH1-L1-VL2-L2-VH3-L3-VL3-L4-VH2-L5-VL1-Fc-Fc; VH1-L1-VL2-L2-VH3-L3-VL3-L4-VH2-L5-VL1-L6-Fc-Fc; VH1-L1-VL2-L2-VH3-L3-VL3-L4-VH2-L5-VL1-L6-Fc-L7-Fc; VL1-L1-VL2-L2-VH3-L3-VL3-L4-VH2-L5-VH1-Fc-Fc; VL1-L1-VL2-L2-VH3-L3-VL3-L4-VH2-L5-VH1-L6-Fc-Fc; VL1-L1-VL2-L2-VH3-L3-VL3-L4-VH2-L5-VH1-L6-Fc-L7-Fc; VH1-L1-VH2-L2-VL3-L3-VH3-L4-VL2-L5-VL1-L6-Fc-Fc; VH1-L1-VH2-L2-VL3-L3-VH3-L4-VL2-L5-VL1-L6-Fc-L7-Fc; L1-L1-VH2-L2-VH3-L3-VL3-L4-VL2-L5-VH1-Fc-Fc; VL1-L1-VH2-L2-VH3-L3-

VL3-L4-VL2-L5-VH1-L6-Fc-Fc; VL1-L1-VH2-L2-VH3-L3-VL3-L4-VL2-L5-VH1-L6-Fc-L7-Fc; VH1-L1-VL2-L2-VL3-L3-VH3-L4-VH2-L5-VL1-Fc-Fc; VH1-L1-VL2-L2-VL3-L3-VH3-L4-VH2-L5-VL1-L6-Fc-Fc; or VH1-L1-VL2-L2-VL3-L3-VH3-L4-VH2-L5-VL1-L6-Fc-L7-Fc; wherein VL1 is a first immuno globulin light chain variable region that specifically binds to an HIV protein; VL2 is a second immunoglobulin light chain variable region that specifically binds to an HIV protein; VL3 is a third immunoglobulin light chain variable region that specifically binds to an HIV protein; VH1 is a first immunoglobulin heavy chain variable region that specifically binds to an HIV protein; VH2 is a second immunoglobulin heavy chain variable region that specifically binds to an HIV protein; VH3 is a third immunoglobulin heavy chain variable region that specifically binds to an HIV protein; Fc is a region comprising an immunoglobulin heavy chain constant region 2 (CH2), an immunoglobulin heavy chain constant region 3 (CH3), and optionally, an immunoglobulin hinge; and L1, L2, L3, L4, L5, L6 and L7 are amino acid linkers. In some aspects, the polypeptide has a structure represented by VL1-VL2-VL3-VH3-VH2-VH1-Fc-Fc; wherein VL1, VL2, VL3, VH1, VH2, and/or VH3 specifically binds to an HIV protein. In some aspects, the polypeptide has a structure represented by VH1-VH2-VH3-VL3-VL2-VL1-Fc-Fc; wherein VL1, VL2, VL3, VH1, VH2, and/or VH3 specifically binds to an HIV protein. In some aspects, the polypeptide has a structure represented by VL1-VH2-VL3-VH3-VL2-VH1-Fc-Fc; wherein VL1, VL2, VL3, VH1, VH2, and/or VH3 specifically binds to an HIV protein. In some aspects, the polypeptide has a structure represented by VH1-VL2-VH3-VL3-VH2-VL1-Fc-Fc; wherein VL1, VL2, VL3, VH1, VH2, and/or VH3 specifically binds to an HIV protein. In some aspects, the polypeptide has a structure represented by VL1-VL2-VH3-VL3-VH2-VH1-Fc-Fc; wherein VL1, VL2, VL3, VH1, VH2, and/or VH3 specifically binds to an HIV protein. In some aspects, the polypeptide has a structure represented by VH1-VH2-VL3-VH3-VL2-VL1-Fc-Fc; wherein VL1, VL2, VL3, VH1, VH2, and/or VH3 specifically binds to an HIV protein. In some aspects, the polypeptide has a structure represented by VL1-VH2-VH3-VL3-VL2-VH1-Fc-Fc; wherein VL1, VL2, VL3, VH1, VH2, and/or VH3 specifically binds to an HIV protein. In some aspects, the polypeptide has a structure represented by VH1-VL2-VL3-VH3-VH2-VL1-Fc-Fc; wherein VL1, VL2, VL3, VH1, VH2, and/or VH3 specifically binds to an HIV protein. In some aspects, the polypeptide has a structure represented by VL1-L1-VL2-L2-VL3-L3-VH3-L4-VH2-L5-VH1-Fc-Fc; wherein VL1, VL2, VL3, VH1, VH2, and/or VH3 specifically binds to an HIV protein. In some aspects, the polypeptide has a structure represented by VL1-L1-VL2-L2-VL3-L3-VH3-L4-VH2-L5-VH1-L6-Fc-Fc; wherein VL1, VL2, VL3, VH1, VH2, and/or VH3 specifically binds to an HIV protein. In some aspects, the polypeptide has a structure represented by VL1-L1-VL2-L2-VL3-L3-VH3-L4-VH2-L5-VH1-L6-Fc-L7-Fc; wherein VL1, VL2, VL3, VH1, VH2, and/or VH3 specifically binds to an HIV protein. In some aspects, the polypeptide has a structure represented by VH1-L1-VH2-L2-VH3-L3-VL3-L4-VL2-L5-VL1-Fc-Fc; wherein VL1, VL2, VL3, VH1, VH2, and/or VH3 specifically binds to an HIV protein. In some aspects, the polypeptide has a structure represented by VH1-L1-VH2-L2-VH3-L3-VL3-L4-VL2-L5-VL1-L6-Fc-Fc; wherein VL1, VL2, VL3, VH1, VH2, and/or VH3 specifically binds to an HIV protein. In some aspects, the polypeptide has a structure represented by VH1-L1-VH2-L2-VH3-L3-VL3-L4-VL2-L5-VL1-L6-Fc- L7-Fc; wherein VL1, VL2, VL3, VH1, VH2, and/or VH3 specifically binds to an HIV protein. In some aspects, the polypeptide has a structure represented by VL1-L1-VH2-L2-VL3-L3-VH3-L4-VL2-L5-VH1-Fc-Fc; wherein VL1, VL2, VL3, VH1, VH2, and/or VH3 specifically binds to an HIV protein. In some aspects, the polypeptide has a structure represented by VL1-L1-VH2-L2-VL3-L3-VH3-L4-VL2-L5-VH1-L6-Fc-Fc; wherein VL1, VL2, VL3, VH1, VH2, and/or VH3 specifically binds to an HIV protein. In some aspects, the polypeptide has a structure represented by VL1-L1-VH2-L2-VL3-L3-VH3-L4-VL2-L5-VH1-L6-Fc-L7-Fc; wherein VL1, VL2, VL3, VH1, VH2, and/or VH3 specifically binds to an HIV protein. In some aspects, the polypeptide has a structure represented by VH1-L1-VL2-L2-VH3-L3-VL3-L4-VH2-L5-VL1-Fc-Fc; wherein VL1, VL2, VL3, VH1, VH2, and/or VH3 specifically binds to an HIV protein. In some aspects, the polypeptide has a structure represented by VH1-L1-VL2-L2-VH3-L3-VL3-L4-VH2-L5-VL1-L6-Fc-Fc; wherein VL1, VL2, VL3, VH1, VH2, and/or VH3 specifically binds to an HIV protein. In some aspects, the polypeptide has a structure represented by VH1-L1-VL2-L2-VH3-L3-VL3-L4-VH2-L5-VL1-L6-Fc-L7-Fc; wherein VL1, VL2, VL3, VH1, VH2, and/or VH3 specifically binds to an HIV protein. In some aspects, the polypeptide has a structure represented by VL1-L1-VL2-L2-VH3-L3-VL3-L4-VH2-L5-VH1-Fc-Fc; wherein VL1, VL2, VL3, VH1, VH2, and/or VH3 specifically binds to an HIV protein. In some aspects, the polypeptide has a structure represented by VL1-L1-VL2-L2-VH3-L3-VL3-L4-VH2-L5-VH1-L6-Fc-Fc; wherein VL1, VL2, VL3, VH1, VH2, and/or VH3 specifically binds to an HIV protein. In some aspects, the polypeptide has a structure represented by VL1-L1-VL2-L2-VH3-L3-VL3-L4-VH2-L5-VH1-L6-Fc-L7-Fc; wherein VL1, VL2, VL3, VH1, VH2, and/or VH3 specifically binds to an HIV protein. In some aspects, the polypeptide has a structure represented by VH1-L1-VH2-L2-VL3-L3-VH3-L4-VL2-L5-VL1-Fc-Fc; wherein VL1, VL2, VL3, VH1, VH2, and/or VH3 specifically binds to an HIV protein. In some aspects, the polypeptide has a structure represented by VH1-L1-VH2-L2-VL3-L3-VH3-L4-VL2-L5-VL1-L6-Fc-Fc; wherein VL1, VL2, VL3, VH1, VH2, and/or VH3 specifically binds to an HIV protein. In some aspects, the polypeptide has a structure represented by VH1-L1-VH2-L2-VL3-L3-VH3-L4-VL2-L5-VL1-L6-Fc-L7-Fc; wherein VL1, VL2, VL3, VH1, VH2, and/or VH3 specifically binds to an HIV protein. In some aspects, the polypeptide has a structure represented by L1-L1-VH2-L2-VH3-L3-VL3-L4-VL2-L5-VH1-Fc-Fc; wherein VL1, VL2, VL3, VH1, VH2, and/or VH3 specifically binds to an HIV protein. In some aspects, the polypeptide has a structure represented by VL1-L1-VH2-L2-VH3-L3-VL3-L4-VL2-L5-VH1-L6-Fc-Fc; wherein VL1, VL2, VL3, VH1, VH2, and/or VH3 specifically binds to an HIV protein. In some aspects, the polypeptide has a structure represented by VL1-L1-VH2-L2-VH3-L3-VL3-L4-VL2-L5-VH1-L6-Fc-L7-Fc; wherein VL1, VL2, VL3, VH1, VH2, and/or VH3 specifically binds to an HIV protein. In some aspects, the polypeptide has a structure represented by VH1-L1-VL2-L2-VL3-L3-VH3-L4-VH2-L5-VL1-Fc-Fc; wherein VL1, VL2, VL3, VH1, VH2, and/or VH3 specifically binds to an HIV protein. In some aspects, the polypeptide has a structure represented by; wherein VL1, VL2, VL3, VH1, VH2, and/or VH3 specifically binds to an HIV protein. In some aspects, the polypeptide has a structure represented by VH1-L1-VL2-L2-VL3-L3-VH3-L4-VH2-L5-VL1-L6-Fc-Fc; wherein VL1, VL2, VL3, VH1, VH2, and/or VH3 specifically binds to an HIV protein. In some aspects, the polypeptide has a structure represented by VH1-L1-VL2-L2-VL3-L3-VH3-L4-VH2-L5-VL1-L6-Fc-L7-Fc, wherein VL1, VL2, VL3, VH1, VH2, and/or VH3 specifically binds to an HIV protein. For the avoidance of doubt, all the antigen binding polypeptide structures described herein can be combined with any one or more of the HIV targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VH1, VH2, and/or VH3 of each and every antigen binding polypeptide and antigen binding polypeptide complex described herein may independently bind to any one of said particularly preferred targets.

In some aspects, the antigen binding polypeptide complex comprises a first polypeptide and a second polypeptide; wherein the first polypeptide has a structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VH2-VL1-Fc; VH1-VL2-VL3-VH3-VH2-VL1-Fc; VL1-L1-VL2-L2-VL3-L3-VH3-L4-VH2-L5-VH1-Fc; VL1-L1-VL2-L2-VL3-L3-VH3-L4-VH2-L5-VH1-L6-Fc; VH1-L1-VH2-L2-VH3-L3-VL3-L4-VL2-L5-VL1-Fc; VH1-L1-VH2-L2-VH3-L3-VL3-L4-VL2-L5-VL1-L6-Fc; VL1-L1-VH2-L2-VL3-L3-VH3-L4-VL2-L5-VH1-Fc; VL1-L1-VH2-L2-VL3-L3-VH3-L4-VL2-L5-VH1-L6-Fc; VH1-L1-VL2-L2-VH3-L3-VL3-L4-VH2-L5-VL1-Fc; VH1-L1-VL2-L2-VH3-L3-VL3-L4-VH2-L5-VL1-L6-Fc; VL1-L1-VL2-L2-VH3-L3-VL3-L4-VH2-L5-VH1-Fc; VL1-L1-VL2-L2-VH3-L3-VL3-L4-VH2-L5-VH1-L6-Fc; VH1-L1-VH2-L2-VL3-L3-VH3-L4-VL2-L5-VL1-Fc; VH1-L1-VH2-L2-VL3-L3-VH3-L4-VL2-L5-VL1-L6-Fc; VL1-L1-VH2-L2-VH3-L3-VL3-L4-VL2-L5-VH1-Fc; VL1-L1-VH2-L2-VH3-L3-VL3-L4-VL2-L5-VH1-L6-Fc; VH1-L1-VL2-L2-VL3-L3-VH3-L4-VH2-L5-VL1-Fc; or VH1-L1-VL2-L2-VL3-L3-VH3-L4-VH2-L5-VL1-L6-Fc; wherein the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VH6-VL6-VH5-VL4-Fc; VH4-VL5-VL6-VH6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-

VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc; wherein VL1 is a first immunoglobulin light chain variable region that specifically binds to an HIV protein; VL2 is a second immunoglobulin light chain variable region that specifically binds to an HIV protein; VL3 is a third immunoglobulin light chain variable region that specifically binds to an HIV protein; VL4 is a fourth immunoglobulin light chain variable region that specifically binds to an HIV protein; VL5 is a fifth immunoglobulin light chain variable region that specifically binds to an HIV protein; VL6 is a sixth immunoglobulin light chain variable region that specifically binds to an HIV protein; VH1 is a first immunoglobulin heavy chain variable region that specifically binds to an HIV protein; VH2 is a second immunoglobulin heavy chain variable region that specifically binds to an HIV protein; VH3 is a third immunoglobulin heavy chain variable region that specifically binds to an HIV protein; VH4 is a fourth immunoglobulin heavy chain variable region that specifically binds to an HIV protein; VH5 is a fifth immunoglobulin heavy chain variable region that specifically binds to an HIV protein; VH6 is a sixth immunoglobulin heavy chain variable region that specifically binds to an HIV protein; Fc is a region comprising an immunoglobulin heavy chain constant region 2 (CH2), an immunoglobulin heavy chain constant region 3 (CH3), and optionally, an immunoglobulin hinge; and L1, L2, L3, L4, L5, L6, L7, L8, L9, L10, L11 and L12 are amino acid linkers. In some aspects, the first polypeptide has a structure represented by VL1-VL2-VL3-VH3-VH2-VH1-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VH5-L8-VH6-L9-VL6-L10-VL5-L11-VL4-L12-Fc; VH4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-

L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12- Fc; or VH4-L7-VL5-L8-VL6-L9-VH6-L10-VH5-L11-VL4-L12-Fc. In some aspects, the first polypeptide has a structure represented by VH1-VH2-VH3-VL3-VL2-VL1-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VH4-VL5-VH6-VL6-VH5-VL4-Fc; VH4-VH5-VL6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VH6-L10-VH5-L11-VH4-Fc; VH4-L7-VH5-L8-VL6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VH5-L8-VL6-L9-VH6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-VH2-VL3-VH3-VL2-VH1-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VH4-VL5-VH6-VL6-VH5-VL4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VH6-L10-VH5-L11-VH4-Fc; VH4-L7-VH5-L8-VL6-L9-VL6-L10-VH5-L11-VH4-Fc; VH4-L7-VH5-L8-VL6-L9-VH6-

L10-VL5-L11-VL4-Fc; VL4-L7-VH5-L8-VH6-L9-VL6-L10-VL5-L11-VL4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VL6-L9-VH6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-VL2-VH3-VL3-VH2-VL1-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VH5-VH6-VL6-VL5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VH6-L10-VH5-L11-VH4-Fc; VH4-L7-VH5-L8-VL6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VL4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VL6-L9-VH6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-VL2-VH3-VL3-VH2-VH1-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VH5-VL5-

VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VH6-L9-VL6-L10-VH5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VH5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-VH2-VL3-VH3-VL2-VL1-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VH4-VL5-VL6-VH6-VH5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VH5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VH5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-VH2-VH3-VL3-VL2-VH1-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-

VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VH4-VL5-VL6-VH6-VH5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VH5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VH5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VH4-L7-VH5-L8-VH6-L9-VL6-L10-VH5-L11-VH4-L12-Fc; VL4-L7-VH5-L8-VL6-L9-VH6-L10-VL5-L11-VL4-L12-Fc; VH4-L7-VL5-L8-VH6-L9-VL6-L10-VH5-L11-VL4-L12-Fc; or VH4-L7-VL5-L8-VL6-L9-VH6-L10-VH5-L11-VL4-L12-Fc. In some aspects, the first polypeptide has a structure represented by VH1-VL2-VL3-VH3-VH2-VL1-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VH5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VH5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-L1-VL2-L2-VL3-L3-VH3-L4-VH2-L5-VH1-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-

L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-L1-VL2-L2-VL3-L3-VH3-L4-VH2-L5-VH1-L6-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-

VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-L1-VH2-L2-VH3-L3-VL3-L4-VL2-L5-VL1-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-L1-VH2-L2-VH3-L3-VL3-L4-VL2-L5-VL1-L6-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-

L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-L1-VH2-L2-VL3-L3-VH3-L4-VL2-L5-VH1-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VH4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-L1-VH2-L2-VL3-L3-VH3-L4-VL2-L5-VH1-L6-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VH4-L7-CH1-L8-VL4-L9-CL-L10-Fc; VH4-L7-CH1-L8-VL4-L9-CL-Fc; VL4-L7-CH1-L8-VH4-L9-CL-L10-Fc; VL4-VL5-VH5-VH4-Fc; VH4-VH5-VL5-VH4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc;

VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-L1-VL2-L2-VH3-L3-VL3-L4-VH2-L5-VL1-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-L1-VL2-L2-VH3-L3-VL3-L4-VH2-L5-VL1-L6-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-

CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-L1-VL2-L2-VH3-L3-VL3-L4-VH2-L5-VH1-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VL6-VH6-VL5-VH4-Fc; VL4-VH5-VL6-VH6-VL5-VH4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VL1-L1-VL2-L2-VH3-L3-VL3-L4-VH2-L5-VH1-L6-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-L1-VH2-L2-VL3-L3-VH3-L4-VL2-L5-VL1-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VH6-L9-VL6-L10-VL5-L11-VL4-L12-Fc; VL4-L7-VH5-L8-VH6-L9-VL6-L10-VH5-L11-VL4-L12-Fc; VH4-

L7-VL5-L8-VH6-L9-VL6-L10-VH5-L11-VL4-L12-Fc;
VL4-L7-VL5-L8-VH6-L9-VL6-L10-VH5-L11-VH4-L12-
Fc; VH4-L7-VH5-L8-VL6-L9-VH6-L10-VL5-L11-VL4-
L12-Fc; VL4-L7-VH5-L8-VH6-L9-VL6-L10-VL5-L11-
VH4-L12-Fc; or VH4-L7-VL5-L8-VL6-L9-VH6-L10-
VH5-L11-VL4-L12-Fc. In some aspects, the first
polypeptide has a structure represented by VH1-L1-VH2-
L2-VL3-L3-VH3-L4-VL2-L5-VL1-L6-Fc; and the second
polypeptide has a structure represented by VL4-VH4-Fc;
VH4-VL4-Fc; VL4-L7-VH4-Fc; VH4-L7-VL4-Fc; VL4-
L7-VH4-L8-Fc; VH4-L7-VL4-L8-Fc; VL4-CL-VH4-CH1-
Fc; VH4-CL-VL4-CH1-Fc; VL4-CH1-VH4-CL-Fc; VH4-
CH1-VL4-CL-Fc; VL4-L7-CL-L8-VH4-L9-CH1-Fc; VL4-
L7-CL-L8-VH4-L9-CH1-L10-Fc; VH4-L7-CL-L8-VL4-
L9-CH1-Fc; VH4-L7-CL-L8-VL4-L9-CH1-L10-Fc; VL4-
L7-CH1-L8-VH4-L9-CL-Fc; VL4-L7-CH1-L8-VH4-L9-
CL-L10-Fc; VH4-L7-CH1-L8-VL4-L9-CL-Fc; VH4-L7-
CH1-L8-VL4-L9-CL-L10-Fc; VL4-VL5-VH5-VH4-Fc;
VH4-VH5-VL5-VL4-Fc; VL4-L7-VL5-L8-VH5-L9-VH4-
Fc; VH4-L7-VH5-L8-VL5-L9-VL4-Fc; VL4-L7-VL5-L8-
VH5-L9-VH4-L10-Fc; VH4-L7-VH5-L8-VL5-L9-VL4-
L10-Fc; VL4-VL5-VL6-VH6-VH5-VH4-Fc; VH4-VH5-
VH6-VL6-VL5-VL4-Fc; VL4-VH5-VL6-VH6-VL5-VH4-
Fc; VH4-VL5-VH6-VL6-VH5-VL4-Fc; VL4-VL5-VH6-
VL6-VH5-VH4-Fc; VH4-VH5-VL6-VH6-VL5-VL4-Fc;
VL4-VH5-VH6-VL6-VL5-VH4-Fc; VH4-VL5-VL6-VH6-
VH5-VL4-Fc; VL4-L7-VL5-L8-VL6-L9-VH6-L10-VH5-
L11-VH4-Fc; VH4-L7-VH5-L8-VH6-L9-VL6-L10-VL5-
L11-VL4-Fc; VL4-L7-VH5-L8-VL6-L9-VH6-L10-VL5-
L11-VH4-Fc; VH4-L7-VL5-L8-VH6-L9-VL6-L10-VH5-
L11-VL4-Fc; VL4-L7-VL5-L8-VH6-L9-VL6-L10-VH5-
L11-VH4-Fc; VH4-L7-VH5-L8-VL6-L9-VH6-L10-VL5-
L11-VL4-Fc; VL4-L7-VH5-L8-VH6-L9-VL6-L10-VL5-
L11-VH4-Fc; VH4-L7-VL5-L8-VL6-L9-VH6-L10-VH5-
L11-VL4-L12-Fc; VH4-L7-VH5-L8-VH6-L9-VL6-L10-
VL5-L11-VL4-L12-Fc; VL4-L7-VH5-L8-VL6-L9-VH6-
L10-VL5-L11-VH4-L12-Fc; VH4-L7-VL5-L8-VH6-L9-
VL6-L10-VH5-L11-VL4-L12-Fc; VL4-L7-VL5-L8-VH6-
L9-VL6-L10-VH5-L11-VH4-L12-Fc; VH4-L7-VH5-L8-
VL6-L9-VH6-L10-VL5-L11-VL4-L12-Fc; VL4-L7-VH5-
L8-VH6-L9-VL6-L10-VL5-L11-VH4-L12-Fc; or VH4-L7-
VL5-L8-VL6-L9-VH6-L10-VH5-L11-VL4-L12-Fc. In
some aspects, the first polypeptide has a structure repre-
sented by VL1-L1-VH2-L2-VH3-L3-VL3-L4-VL2-L5-
VH1-Fc; and the second polypeptide has a structure repre-
sented by VL4-VH4-Fc; VH4-VL4-Fc; VL4-L7-VH4-Fc;
VH4-L7-VL4-Fc; VL4-L7-VH4-L8-Fc; VH4-L7-VL4-L8-
Fc; VL4-CL-VH4-CH1-Fc; VH4-CL-VL4-CH1-Fc; VL4-
CH1-VH4-CL-Fc; VH4-CH1-VL4-CL-Fc; VL4-L7-CL-L8-
VH4-L9-CH1-Fc; VL4-L7-CL-L8-VH4-L9-CH1-L10-Fc;
VH4-L7-CL-L8-VL4-L9-CH1-Fc; VH4-L7-CL-L8-VL4-
L9-CH1-L10-Fc; VL4-L7-CH1-L8-VH4-L9-CL-Fc; VL4-
L7-CH1-L8-VH4-L9-CL-L10-Fc; VH4-L7-CH1-L8-VL4-
L9-CL-Fc; VH4-L7-CH1-L8-VL4-L9-CL-L10-Fc; VL4-
VL5-VH5-VH4-Fc; VH4-VH5-VL5-VL4-Fc; VL4-L7-
VL5-L8-VH5-L9-VH4-Fc; VH4-L7-VH5-L8-VL5-L9-
VL4-Fc; VL4-L7-VL5-L8-VH5-L9-VH4-L10-Fc; VH4-L7-
VH5-L8-VL5-L9-VL4-L10-Fc; VL4-VL5-VL6-VH6-VH5-
VH4-Fc; VH4-VH5-VH6-VL6-VL5-VL4-Fc; VL4-VH5-
VL6-VH6-VL5-VH4-Fc; VH4-VL5-VH6-VL6-VH5-VL4-
Fc; VL4-VL5-VH6-VL6-VH5-VH4-Fc; VH4-VH5-VL6-
VH6-VL5-VL4-Fc; VL4-VH5-VH6-VL6-VL5-VH4-Fc;
VH4-VL5-VL6-VH6-VH5-VL4-Fc; VL4-L7-VL5-L8-
VL6-L9-VH6-L10-VH5-L11-VH4-Fc; VH4-L7-VH5-L8-
VH6-L9-VL6-L10-VL5-L11-VL4-Fc; VL4-L7-VH5-L8-
VL6-L9-VH6-L10-VL5-L11-VH4-Fc; VH4-L7-VL5-L8-

VH6-L9-VL6-L10-VH5-L11-VL4-Fc; VL4-L7-VL5-L8-
VH6-L9-VL6-L10-VH5-L11-VH4-Fc; VH4-L7-VH5-L8-
VL6-L9-VH6-L10-VL5-L11-VL4-Fc; VL4-L7-VH5-L8-
VH6-L9-VL6-L10-VL5-L11-VH4-Fc; VH4-L7-VL5-L8-
VL6-L9-VH6-L10-VH5-L11-VL4-Fc; VL4-L7-VL5-L8-
VL6-L9-VH6-L10-VH5-L11-VH4-L12-Fc; VH4-L7-VH5-
L8-VH6-L9-VL6-L10-VL5-L11-VL4-L12-Fc; VL4-L7-
VH5-L8-VL6-L9-VH6-L10-VL5-L11-VH4-L12-Fc; VH4-
L7-VL5-L8-VH6-L9-VL6-L10-VH5-L11-VL4-L12-Fc;
VL4-L7-VL5-L8-VH6-L9-VL6-L10-VH5-L11-VH4-L12-
Fc; VH4-L7-VH5-L8-VL6-L9-VH6-L10-VL5-L11-VL4-
L12-Fc; VL4-L7-VH5-L8-VH6-L9-VL6-L10-VL5-L11-
VH4-L12-Fc; or VH4-L7-VL5-L8-VL6-L9-VH6-L10-
VH5-L11-VL4-L12-Fc. In some aspects, the first
polypeptide has a structure represented by VL1-L1-VH2-
L2-VH3-L3-VL3-L4-VL2-L5-VH1-L6-Fc; and the second
polypeptide has a structure represented by VL4-VH4-Fc;
VH4-VL4-Fc; VL4-L7-VH4-Fc; VH4-L7-VL4-Fc; VL4-
L7-VH4-L8-Fc; VH4-L7-VL4-L8-Fc; VL4-CL-VH4-CH1-
Fc; VH4-CL-VL4-CH1-Fc; VL4-CH1-VH4-CL-Fc; VH4-
CH1-VL4-CL-Fc; VL4-L7-CL-L8-VH4-L9-CH1-Fc; VL4-
L7-CL-L8-VH4-L9-CH1-L10-Fc; VH4-L7-CL-L8-VL4-
L9-CH1-Fc; VH4-L7-CL-L8-VL4-L9-CH1-L10-Fc; VL4-
L7-CH1-L8-VH4-L9-CL-Fc; VL4-L7-CH1-L8-VH4-L9-
CL-L10-Fc; VH4-L7-CH1-L8-VL4-L9-CL-Fc; VH4-L7-
CH1-L8-VL4-L9-CL-L10-Fc; VL4-VL5-VH5-VH4-Fc;
VH4-VH5-VL5-VL4-Fc; VL4-L7-VL5-L8-VH5-L9-VH4-
Fc; VH4-L7-VH5-L8-VL5-L9-VL4-Fc; VL4-L7-VL5-L8-
VH5-L9-VH4-L10-Fc; VH4-L7-VH5-L8-VL5-L9-VL4-
L10-Fc; VL4-VL5-VL6-VH6-VH5-VH4-Fc; VH4-VH5-
VH6-VL6-VL5-VL4-Fc; VL4-VH5-VL6-VH6-VL5-VH4-
Fc; VH4-VL5-VH6-VL6-VH5-VL4-Fc; VL4-VL5-VH6-
VL6-VH5-VH4-Fc; VH4-VH5-VL6-VH6-VL5-VL4-Fc;
VL4-VH5-VH6-VL6-VL5-VH4-Fc; VH4-VL5-VL6-VH6-
VH5-VL4-Fc; VL4-L7-VL5-L8-VL6-L9-VH6-L10-VH5-
L11-VH4-Fc; VH4-L7-VH5-L8-VH6-L9-VL6-L10-VL5-
L11-VL4-Fc; VL4-L7-VH5-L8-VL6-L9-VH6-L10-VL5-
L11-VH4-Fc; VH4-L7-VL5-L8-VH6-L9-VL6-L10-VH5-
L11-VL4-Fc; VL4-L7-VL5-L8-VH6-L9-VL6-L10-VH5-
L11-VH4-Fc; VH4-L7-VH5-L8-VL6-L9-VH6-L10-VL5-
L11-VL4-Fc; VL4-L7-VH5-L8-VH6-L9-VL6-L10-VL5-
L11-VH4-Fc; VH4-L7-VL5-L8-VL6-L9-VH6-L10-VH5-
L11-VH4-L12-Fc; VH4-L7-VH5-L8-VH6-L9-VL6-L10-
VL5-L11-VL4-L12-Fc; VL4-L7-VH5-L8-VL6-L9-VH6-
L10-VL5-L11-VH4-L12-Fc; VH4-L7-VL5-L8-VH6-L9-
VL6-L10-VH5-L11-VL4-L12-Fc; VL4-L7-VL5-L8-VH6-
L9-VL6-L10-VH5-L11-VH4-L12-Fc; VH4-L7-VH5-L8-
VL6-L9-VH6-L10-VL5-L11-VL4-L12-Fc; VL4-L7-VH5-
L8-VH6-L9-VL6-L10-VL5-L11-VH4-L12-Fc; or VH4-L7-
VL5-L8-VL6-L9-VH6-L10-VH5-L11-VL4-L12-Fc. In
some aspects, the first polypeptide has a structure repre-
sented by VH1-L1-VL2-L2-VL3-L3-VH3-L4-VH2-L5-
VL1-Fc; and the second polypeptide has a structure repre-
sented by VL4-VH4-Fc; VH4-VL4-Fc; VL4-L7-VH4-Fc;
VH4-L7-VL4-Fc; VL4-L7-VH4-L8-Fc; VH4-L7-VL4-L8-
Fc; VL4-CL-VH4-CH1-Fc; VH4-CL-VL4-CH1-Fc; VL4-
CH1-VH4-CL-Fc; VH4-CH1-VL4-CL-Fc; VL4-L7-CL-L8-
VH4-L9-CH1-Fc; VL4-L7-CL-L8-VH4-L9-CH1-L10-Fc;
VH4-L7-CL-L8-VL4-L9-CH1-Fc; VH4-L7-CL-L8-VL4-
L9-CH1-L10-Fc; VL4-L7-CH1-L8-VH4-L9-CL-Fc; VL4-
L7-CH1-L8-VH4-L9-CL-L10-Fc; VH4-L7-CH1-L8-VL4-
L9-CL-Fc; VH4-L7-CH1-L8-VL4-L9-CL-L10-Fc; VL4-
VL5-VH5-VH4-Fc; VH4-VH5-VL5-VL4-Fc; VL4-L7-
VL5-L8-VH5-L9-VH4-Fc; VH4-L7-VH5-L8-VL5-L9-
VL4-Fc; VL4-L7-VL5-L8-VH5-L9-VH4-L10-Fc; VH4-L7-
VH5-L8-VL5-L9-VL4-L10-Fc; VL4-VL5-VL6-VH6-VH5-

VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH6-VL5-VL4-Fc; VL4-VH5-VH6-VL6-VL5-VH4-Fc; VH4-VL5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VL5-L11-VL4-Fc; VL4-L7-VH5-L8-VL6-L9-VH6-L10-VL5-L11-VH4-Fc; VH4-L7-VL5-L8-VH6-L9-VL6-L10-VH5-L11-VL4-Fc; VL4-L7-VL5-L8-VH6-L9-VL6-L10-VH5-L11-VH4-Fc; VH4-L7-VH5-L8-VL6-L9-VH6-L10-VL5-L11-VL4-Fc; VL4-L7-VH5-L8-VH6-L9-VL6-L10-VL5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. In some aspects, the first polypeptide has a structure represented by VH1-L1-VL2-L2-VL3-L3-VH3-L4-VH2-L5-VL1-L6-Fc; and the second polypeptide has a structure represented by VL4-VH4-Fc; VH4-VL4-Fc; VL4-L7-VH4-Fc; VH4-L7-VL4-Fc; VL4-L7-VH4-L8-Fc; VH4-L7-VL4-L8-Fc; VL4-CL-VH4-CH1-Fc; VH4-CL-VL4-CH1-Fc; VL4-CH1-VH4-CL-Fc; VH4-CH1-VL4-CL-Fc; VL4-L7-CL-L8-VH4-L9-CH1-Fc; VL4-L7-CL-L8-VH4-L9-CH1-L10-Fc; VH4-L7-CL-L8-VL4-L9-CH1-Fc; VH4-L7-CL-L8-VL4-L9-CH1-L10-Fc; VL4-L7-CH1-L8-VH4-L9-CL-Fc; VL4-L7-CH1-L8-VH4-L9-CL-L10-Fc; VH4-L7-CH1-L8-VL4-L9-CL-Fc; VH4-L7-CH1-L8-VL4-L9-CL-L10-Fc; VL4-VL5-VH5-VH4-Fc; VH4-VH5-VL5-VL4-Fc; VL4-L7-VL5-L8-VH5-L9-VH4-Fc; VH4-L7-VH5-L8-VL5-L9-VL4-Fc; VL4-L7-VL5-L8-VH5-L9-VH4-L10-Fc; VH4-L7-VH5-L8-VL5-L9-VL4-L10-Fc; VL4-VL5-VL6-VH6-VH5-VH4-Fc; VH4-VH5-VH6-VL6-VL5-VL4-Fc; VL4-VH5-VL6-VH6-VL5-VH4-Fc; VH4-VL5-VH6-VL6-VH5-VL4-Fc; VL4-VL5-VH6-VL6-VH5-VH4-Fc; VH4-VH5-VL6-VH6-VL5-VL4-Fc; VL4-VH5-VH6-VL6-VL5-VH4-Fc; VH4-VL5-VL6-VH6-VH5-VL4-Fc; VH4-VH5-VL6-VH6-VH5-VL4-Fc; VL4-L7-VL5-L8-VL6-L9-VH6-L10-VH5-L11-VH4-Fc; VH4-L7-VH5-L8-VH6-L9-VL6-L10-VH5-L11-VL4-Fc; VL4-L7-VH5-L8-VL6-L9-VH6-L10-VL5-L11-VH4-Fc; VH4-L7-VH5-L8-VL6-L9-VL6-L10-VH5-L11-VL4-Fc; VL4-L7-VL5-L8-VH6-L9-VL6-L10-VH5-L11-VH4-Fc; VH4-L7-VH5-L8-VH6-L9-VL6-L10-VH5-L11-VL4-Fc; VL4-L7-VH5-L8-VH6-L9-VL6-L10-VH5-L11-VH4-Fc; VH4-L7-VL5-L8-VL6-L9-VH6-L10-VH5-L11-VL4-Fc; VL4-L7-VL5-L8-VL6-L9-VH6-L10-VH5-L11-VH4-L12-Fc; VH4-L7-VH5-L8-VH6-L9-VL6-L10-VL5-L11-VL4-L12-Fc; VL4-L7-VH5-L8-VL6-L9-VH6-L10-VL5-L11-VH4-L12-Fc; VH4-L7-VL5-L8-VH6-L9-VL6-L10-VH5-L11-VL4-L12-Fc; VL4-L7-VL5-L8-VH6-L9-VL6-L10-VH5-L11-VH4-L12-Fc; VH4-L7-VH5-L8-VL6-L9-VH6-L10-VL5-L11-VL4-L12-Fc; VL4-L7-VH5-L8-VH6-L9-VL6-L10-VL5-L11-VH4-L12-Fc; or VH4-L7-VL5-L8-VL6-L9-VH6-L10-VH5-L11-VL4-L12-Fc. The VL1, VL2, VL3, VL4, VL5, VL6, VH1, VH2, VH3, VH4, VH5, and/or VH6 may specifically bind to a HIV protein as described herein. For the avoidance of doubt, all the antigen binding polypeptide structures described herein can be combined with any one or more of the HIV targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VL4, VL5, VL6, VH1, VH2, VH3, VH4, VH5 and/or VH6 of each and every antigen binding polypeptide and antigen binding polypeptide complex described herein may independently bind to any one of said particularly preferred targets.

In some aspects, the antigen binding polypeptide has a structure represented by VL1-VL2-VL3-VH3-VH2-VH1-CH1-CL; VL1-VL2-VL3-VH3-VH2-VH1-CL-CH1; VH1-VH2-VH3-VL3-VL2-VL1-CH1-CL; VH1-VH2-VH3-VL3-VL2-VL1-CL-CH1; VL1-VH2-VL3-VH3-VL2-VH1-CH1-CL; VL1-VH2-VL3-VH3-VL2-VH1-CL-CH1; VH1-VL2-VH3-VL3-VH2-VL1-CH1-CL; VH1-VL2-VH3-VL3-VH2-VL1-CL-CH1; VL1-VL2-VH3-VL3-VH2-VH1-CH1-CL; VL1-VL2-VH3-VL3-VH2-VH1-CL-CH1; VH1-VH2-VL3-VH3-VL2-VL1-CH1-CL; VH1-VH2-VL3-VH3-VL2-VL1-CL-CH1; VL1-VH2-VH3-VL3-VL2-VH1-CH1-CL; VL1-VH2-VH3-VL3-VL2-VH1-CL-CH1; VH1-VL2-VL3-VH3-VH2-VL1-CH1-CL; VH1-VL2-VL3-VH3-VH2-VL1-CL-CH1; VL1-L1-VL2-L2-VL3-L3-VH3-L4-VH2-L5-VH1-CH1-CL; VL1-L1-VL2-L2-VL3-L3-VH3-L4-VH2-L5-VH1-L6-CH1-CL; VL1-L1-VL2-L2-VL3-L3-VH3-L4-VH2-L5-VH1-CL-CH1; VL1-L1-VL2-L2-VL3-L3-VH3-L4-VH2-L5-VH1-L6-CL-CH1; VL1-L1-VL2-L2-VL3-L3-VH3-L4-VH2-L5-VH1-L6-CL-L7-CH1; VH1-L1-VH2-L2-VH3-L3-VL3-L4-VL2-L5-VL1-CH1-CL; VH1-L1-VH2-L2-VH3-L3-VL3-L4-VL2-L5-VL1-L6-CH1-CL; VH1-L1-VH2-L2-VH3-L3-VL3-L4-VL2-L5-VL1-L6-CH1-L7-CL; VH1-L1-VH2-L2-VH3-L3-VL3-L4-VL2-L5-VL1-CL-CH1; VH1-L1-VH2-L2-VH3-L3-VL3-L4-VL2-L5-VL1-L6-CL-CH1; VL1-L1-VH2-L2-VH3-L3-VH3-L4-VL2-L5-VH1-CH1-CL; VL1-L1-VH2-L2-VH3-L3-VH3-L4-VL2-L5-VH1-L6-CH1-CL; VL1-L1-VH2-L2-VH3-L3-VH3-L4-VL2-L5-VH1-L6-CH1-L7-CL; VL1-L1-VH2-L2-VH3-L3-VL3-L3-VH3-L4-VL2-L5-VH1-CL-CH1; VL1-L1-VH2-L2-VL3-L3-VH3-L4-VL2-L5-VH1-L6-CL-CH1; VH1-L1-VL2-L2-VL3-L3-VL3-L4-VH2-L5-VL1-CH1-CL; VH1-L1-VL2-L2-VH3-L3-VL3-L4-VH2-L5-VL1-L6-CH1-CL; VH1-L1-VL2-L2-VH3-L3-VL3-L4-VH2-L5-VL1-L6-CH1-L7-CL; VH1-L1-VL2-L2-VH3-L3-VL3-L4-VH2-L5-VL1-CL-CH1; VH1-L1-VL2-L2-VH3-L3-VL3-L4-VH2-L5-VL1-L6-CL- L7-CH1; VL1-L1-VL2-L2-VH3-L3-VL3-L4-VH2-L5-VH1-CH1-CL; VL1-L1-VL2-L2-VH3-L3-VL3-L4-VH2-L5-VH1-L6-CH1-CL; VL1-L1-VL2-L2-VH3-L3-VL3-L4-VH2-L5-VH1-L6-CH1-L7-CL; VL1-L1-VL2-L2-VH3-L3-VL3-L4-VH2-L5-VH1-CL-CH1; VL1-L1-VL2-L2-VH3-L3-VL3-L4-VH2-L5-VH1-L6-CL-CH1; VL1-L1-VL2-L2-VH3-L3-VL3-L4-VH2-L5-VH1-L6-CL-L7-CH1; VH1-L1-VH2-L2-VL3-L3-VH3-L4-VL2-L5-VL1-CH1-CL; VH1-L1-VH2-L2-VL3-L3-VH3-L4-VL2-L5-VL1-L6-CH1-CL; VH1-L1-VH2-L2-VL3-L3-VH3-L4-VL2-L5-VL1-L6-CH1-L7-CL; VH1-L1-VH2-L2-VL3-L3-VH3-L4-VL2-L5-VL1-CL-CH1; VH1-L1-VH2-L2-VL3-L3-VH3-L4-VL2-L5-VL1-L6-CL-CH1; VH1-L1-VH2-L2-VL3-L3-VH3-L4-VL2-L5-VL1-L6-CL-L7-CH1; VL1-L1-VH2-L2-VL3-L3-VH3-L4-VL2-L5-VH1-CH1-CL; VL1-L1-VH2-L2-VL3-L3-VH3-L4-VL2-L5-VH1-L6-CH1-CL; VH1-L1-VH2-L2-VL3-L3-VH3-L4-VL2-L5-VL1-CL-CH1; VL1-L1-VH2-L2-VL3-L3-VH3-L4-VL2-L5-VL1-L6-CL-CH1; VL1-L1-VL2-L2-VL3-L3-VH3-L4-VH2-L5-VL1-L6-CH1-L7-CL; VH1-L1-

VL2-L2-VL3-L3-VH3-L4-VH2-L5-VL1-CL- CH1; VH1-L1-VL2-L2-VL3-L3-VH3-L4-VH2-L5-VL1-L6-CL-CH1; or VH1-L1-VL2-L2-VL3-L3-VH3-L4-VH2-L5-VL1-L6-CL-L7-CH1; wherein VL1 is a first immunoglobulin light chain variable region that specifically binds to an HIV protein; VL2 is a second immunoglobulin light chain variable region that specifically binds to an HIV protein; VL3 is a third immunoglobulin light chain variable region that specifically binds to an HIV protein; VH1 is a first immunoglobulin heavy chain variable region that specifically binds to an HIV protein; VH2 is a second immunoglobulin heavy chain variable region that specifically binds to an HIV protein; VH3 is a third immunoglobulin heavy chain variable region that specifically binds to an HIV protein; CH1 is a heavy chain constant region 1; CL is a light chain constant region; and L1, L2, L3, L4, L5, L6 and L7 are amino acid linkers. In some aspects, the polypeptide has a structure represented by VL1-VL2-VL3-VH3-VH2-VH1-CH1-CL, wherein VL1, VL2, VL3, VH1, VH2, and/or VH3 specifically binds to an HIV protein. In some aspects, the polypeptide has a structure represented by VL1-VL2-VL3-VH3-VH2-VH1-CL-CH1, wherein VL1, VL2, VL3, VH1, VH2, and/or VH3 specifically binds to an HIV protein. In some aspects, the polypeptide has a structure represented by VH1-VH2-VH3-VL3-VL2-VL1-CH1-CL, wherein VL1, VL2, VL3, VH1, VH2, and/or VH3 specifically binds to an HIV protein. In some aspects, the polypeptide has a structure represented by VH1-VH2-VH3-VL3-VL2-VL1-CL-CH1, wherein VL1, VL2, VL3, VH1, VH2, and/or VH3 specifically binds to an HIV protein. In some aspects, the polypeptide has a structure represented by VL1-VH2-VL3-VH3-VL2-VH1-CH1-CL, wherein VL1, VL2, VL3, VH1, VH2, and/or VH3 specifically binds to an HIV protein. In some aspects, the polypeptide has a structure represented by VL1-VH2-VL3-VH3-VL2-VH1-CL-CH1, wherein VL1, VL2, VL3, VH1, VH2, and/or VH3 specifically binds to an HIV protein. In some aspects, the polypeptide has a structure represented by VH1-VL2-VH3-VL3-VH2-VL1-CH1-CL, wherein VL1, VL2, VL3, VH1, VH2, and/or VH3 specifically binds to an HIV protein. In some aspects, the polypeptide has a structure represented by VH1-VL2-VH3-VL3-VH2-VL1-CL-CH1, wherein VL1, VL2, VL3, VH1, VH2, and/or VH3 specifically binds to an HIV protein. In some aspects, the polypeptide has a structure represented by VL1-VL2-VH3-VL3-VH2-VH1-CH1-CL, wherein VL1, VL2, VL3, VH1, VH2, and/or VH3 specifically binds to an HIV protein. In some aspects, the polypeptide has a structure represented by VL1-VL2-VH3-VL3-VH2-VH1-CL-CH1, wherein VL1, VL2, VL3, VH1, VH2, and/or VH3 specifically binds to an HIV protein. In some aspects, the polypeptide has a structure represented by VH1-VH2-VL3-VH3-VL2-VL1-CH1-CL, wherein VL1, VL2, VL3, VH1, VH2, and/or VH3 specifically binds to an HIV protein. In some aspects, the polypeptide has a structure represented by, wherein VL1, VL2, VL3, VH1, VH2, and/or VH3 specifically binds to an HIV protein. In some aspects, the polypeptide has a structure represented by VH1-VH2-VL3-VH3-VL2-VL1-CL-CH1, wherein VL1, VL2, VL3, VH1, VH2, and/or VH3 specifically binds to an HIV protein. In some aspects, the polypeptide has a structure represented by, wherein VL1, VL2, VL3, VH1, VH2, and/or VH3 specifically binds to an HIV protein. In some aspects, the polypeptide has a structure represented by VL1-VH2-VH3-VL3-VL2-VH1-CH1-CL, wherein VL1, VL2, VL3, VH1, VH2, and/or VH3 specifically binds to an HIV protein. In some aspects, the polypeptide has a structure represented by VL1-VH2-VH3-VL3-VL2-VH1-CL-CH1, wherein VL1, VL2, VL3, VH1, VH2, and/or VH3 specifically binds to an HIV protein. In some aspects, the polypeptide has a structure represented by VH1-VL2-VL3-VH3-VH2-VL1-CH1-CL, wherein VL1, VL2, VL3, VH1, VH2, and/or VH3 specifically binds to an HIV protein. In some aspects, the polypeptide has a structure represented by VH1-VL2-VL3-VH3-VH2-VL1-CL-CH1, wherein VL1, VL2, VL3, VH1, VH2, and/or VH3 specifically binds to an HIV protein. In some aspects, the polypeptide has a structure represented by VL1-L1-VL2-L2-VL3-L3-VH3-L4-VH2-L5-VH1-CH1-CL, wherein VL1, VL2, VL3, VH1, VH2, and/or VH3 specifically binds to an HIV protein. In some aspects, the polypeptide has a structure represented by VL1-L1-VL2-L2-VL3-L3-VH3-L4-VH2-L5-VH1-L6-CH1-CL, wherein VL1, VL2, VL3, VH1, VH2, and/or VH3 specifically binds to an HIV protein. In some aspects, the polypeptide has a structure represented by VL1-L1-VL2-L2-VL3-L3-VH3-L4-VH2-L5-VH1-CL-CH1, wherein VL1, VL2, VL3, VH1, VH2, and/or VH3 specifically binds to an HIV protein. In some aspects, the polypeptide has a structure represented by VL1-L1-VL2-L2-VL3-L3-VH3-L4-VH2-L5-VH1-L6-CL-CH1, wherein VL1, VL2, VL3, VH1, VH2, and/or VH3 specifically binds to an HIV protein. In some aspects, the polypeptide has a structure represented by VL1-L1-VL2-L2-VL3-L3-VH3-L4-VH2-L5-VH1-L6-CL-L7-CH1, wherein VL1, VL2, VL3, VH1, VH2, and/or VH3 specifically binds to an HIV protein. In some aspects, the polypeptide has a structure represented by VH1-L1-VH2-L2-VH3-L3-VL3-L4-VL2-L5-VL1-CH1-CL, wherein VL1, VL2, VL3, VH1, VH2, and/or VH3 specifically binds to an HIV protein. In some aspects, the polypeptide has a structure represented by VH1-L1-VH2-L2-VH3-L3-VL3-L4-VL2-L5-VL1-L6-CH1-CL, wherein VL1, VL2, VL3, VH1, VH2, and/or VH3 specifically binds to an HIV protein. In some aspects, the polypeptide has a structure represented by VH1-L1-VH2-L2-VH3-L3-VL3-L4-VL2-L5-VL1-L6-CH1-L7-CL, wherein VL1, VL2, VL3, VH1, VH2, and/or VH3 specifically binds to an HIV protein. In some aspects, the polypeptide has a structure represented by VH1-L1-VH2-L2-VH3-L3-VL3-L4-VL2-L5-VL1-CL-CH1, wherein VL1, VL2, VL3, VH1, VH2, and/or VH3 specifically binds to an HIV protein. In some aspects, the polypeptide has a structure represented by VH1-L1-VH2-L2-VH3-L3-VL3-L4-VL2-L5-VL1-L6-CL-CH1, wherein VL1, VL2, VL3, VH1, VH2, and/or VH3 specifically binds to an HIV protein. In some aspects, the polypeptide has a structure represented by VL1-L1-VH2-L2-VL3-L3-VH3-L4-VL2-L5-VH1-CH1-CL, wherein VL1, VL2, VL3, VH1, VH2, and/or VH3 specifically binds to an HIV protein. In some aspects, the polypeptide has a structure represented by VL1-L1-VH2-L2-VL3-L3-VH3-L4-VL2-L5-VH1-L6-CH1-CL, wherein VL1, VL2, VL3, VH1, VH2, and/or VH3 specifically binds to an HIV protein. In some aspects, the polypeptide has a structure represented by VL1-L1-VH2-L2-VL3-L3-VH3-L4-VL2-L5-VH1-L6-CH1-L7-CL, wherein VL1, VL2, VL3, VH1, VH2, and/or VH3 specifically binds to an HIV protein. In some aspects, the polypeptide has a structure represented by VL1-L1-VH2-L2-VL3-L3-VH3-L4-VL2-L5-VH1-CL-CH1, wherein VL1, VL2, VL3, VH1, VH2, and/or VH3 specifically binds to an HIV protein. In some aspects, the polypeptide has a structure represented by VL1-L1-VH2-L2-VL3-L3-VH3-L4-VL2-L5-VH1-L6-CL-CH1, wherein VL1, VL2, VL3, VH1, VH2, and/or VH3 specifically binds to an HIV protein. In some aspects, the polypeptide has a structure represented by VH1-L1-VL2-L2-VH3-L3-VL3-L4-VH2-L5-VL1-CH1-CL, wherein VL1, VL2, VL3, VH1, VH2, and/or VH3 specifically binds to an HIV protein. In some aspects, the polypeptide has a structure represented by VH1-L1-VL2-L2-VH3-L3-VL3-L4-VH2-L5-VL1-L6-CH1-CL, wherein VL1, VL2, VL3, VH1, VH2, and/or VH3 specifically binds to an HIV protein. In some aspects, the polypeptide has a structure represented by VH1-L1-VL2-L2-VH3-L3-VL3-L4-VH2-L5-VL1-L6-CH1-L7-CL, wherein VL1, VL2, VL3, VH1, VH2, and/or VH3 specifically binds to an HIV protein. In some aspects, the polypeptide has a structure represented by VH1-L1-VL2-L2-VH3-L3-VL3-L4-VH2-L5-VL1-CL-CH1, wherein VL1, VL2, VL3, VH1, VH2, and/or VH3 specifically binds to an HIV protein. In some aspects, the polypeptide has a structure represented by VH1-L1-VL2-L2-VH3-L3-VL3-L4-VH2-L5-VL1-L6-CL-CH1, wherein VL1, VL2, VL3, VH1, VH2, and/or VH3 specifically binds to an HIV protein. In some aspects, the polypeptide has a structure represented by VH1-L1-VL2-L2-VH3-L3-VL3-L4-VH2-L5-VL1-L6-CL-L7-CH1, wherein VL1, VL2, VL3, VH1, VH2, and/or VH3 specifically binds to an HIV protein. In some aspects, the polypeptide has a structure represented by VL1-L1-VL2-L2-VH3-L3-VL3-L4-VH2-L5-VH1-CH1-CL, wherein VL1, VL2, VL3, VH1, VH2, and/or VH3 specifically binds to an HIV protein. In some aspects, the polypeptide has a structure represented by VL1-L1-VL2-L2-VH3-L3-VL3-L4-VH2-L5-VH1-L6-CH1-CL, wherein VL1, VL2, VL3, VH1, VH2, and/or VH3 specifically binds to an HIV protein. In some aspects, the polypeptide has a structure represented by VL1-L1-VL2-L2-VH3-L3-VL3-L4-VH2-L5-VH1-L6-CH1-L7-CL, wherein VL1, VL2, VL3, VH1, VH2, and/or VH3 specifically binds to an HIV protein. In some aspects, the polypeptide has a structure represented by VL1-L1-VL2-L2-VH3-L3-VL3-L4-VH2-L5-VH1-CL-CH1, wherein VL1, VL2, VL3, VH1, VH2, and/or VH3 specifically binds to an HIV protein. In some aspects, the polypeptide has a structure represented by VL1-L1-VL2-L2-VH3-L3-VL3-L4-VH2-L5-VH1-L6-CL-L7-CH1, wherein VL1, VL2, VL3, VH1, VH2, and/or VH3 specifically binds to an HIV protein. In some aspects, the polypeptide has a structure represented by VH1-L1-VH2-L2-VL3-L3-VH3-L4-VL2-L5-VL1-CH1-CL, wherein VL1, VL2, VL3, VH1, VH2, and/or VH3 specifically binds to an HIV protein. In some aspects, the polypeptide has a structure represented by VH1-L1-VH2-L2-VL3-L3-VH3-L4-VL2-L5-VL1-L6-CH1-CL, wherein VL1, VL2, VL3, VH1, VH2, and/or VH3 specifically binds to an HIV protein. In some aspects, the polypeptide has a structure represented by VH1-L1-VH2-L2-VL3-L3-VH3-L4-VL2-L5-VL1-L6-CH1-L7-CL, wherein VL1, VL2, VL3, VH1, VH2, and/or VH3 specifically binds to an HIV protein. In some aspects, the polypeptide has a structure represented by VH1-L1-VH2-L2-VL3-L3-VH3-L4-VL2-L5-VL1-CL-CH1, wherein VL1, VL2, VL3, VH1, VH2, and/or VH3 specifically binds to an HIV protein. In some aspects, the polypeptide has a structure represented by VH1-L1-VH2-L2-VL3-L3-VH3-L4-VL2-L5-VL1-L6-CL-CH1, wherein VL1, VL2, VL3, VH1, VH2, and/or VH3 specifically binds to an HIV protein. In some aspects, the polypeptide has a structure represented by VH1-L1-VH2-L2-VL3-L3-VH3-L4-VL2-L5-VL1-L6-CL-L7-CH1, wherein VL1, VL2, VL3, VH1, VH2, and/or VH3 specifically binds to an HIV protein. In some aspects, the polypeptide has a structure represented by VL1-L1-VH2-L2-VH3-L3-VL3-L4-VL2-L5-VH1-CH1-CL, wherein VL1, VL2, VL3, VH1, VH2, and/or VH3 specifically binds to an HIV protein.

In some aspects, the polypeptide has a structure represented by VL1-L1-VH2-L2-VH3-L3-VL3-L4-VL2-L5-VH1-L6-CH1-L7-CL, wherein VL1, VL2, VL3, VH1, VH2, and/or VH3 specifically binds to an HIV protein. In some aspects, the polypeptide has a structure represented by VL1-L1-VH2-L2-VH3-L3-VL3-L4-VL2-L5-VH1-CL-CH1, wherein VL1, VL2, VL3, VH1, VH2, and/or VH3 specifically binds to an HIV protein. In some aspects, the polypeptide has a structure represented by VL1-L1-VH2-L2-VH3-L3-VL3-L4-VL2-L5-VH1-L6-CL-CH1, wherein VL1, VL2, VL3, VH1, VH2, and/or VH3 specifically binds to an HIV protein. In some aspects, the polypeptide has a structure represented by VL1-L1-VH2-L2-VH3-L3-VL3-L4-VL2-L5-VH1-L6-CL-L7-CH1, wherein VL1, VL2, VL3, VH1, VH2, and/or VH3 specifically binds to an HIV protein. In some aspects, the polypeptide has a structure represented by VH1-L1-VL2-L2-VL3-L3-VH3-L4-VH2-L5-VL1-CH1-CL, wherein VL1, VL2, VL3, VH1, VH2, and/or VH3 specifically binds to an HIV protein. In some aspects, the polypeptide has a structure represented by VH1-L1-VL2-L2-VL3-L3-VH3-L4-VH2-L5-VL1-L6-CH1-CL, wherein VL1, VL2, VL3, VH1, VH2, and/or VH3 specifically binds to an HIV protein. In some aspects, the polypeptide has a structure represented by VH1-L1-VL2-L2-VL3-L3-VH3-L4-VH2-L5-VL1-L6-CH1-L7-CL, wherein VL1, VL2, VL3, VH1, VH2, and/or VH3 specifically binds to an HIV protein. In some aspects, the polypeptide has a structure represented by VH1-L1-VL2-L2-VL3-L3-VH3-L4-VH2-L5-VL1-CL-CH1, wherein VL1, VL2, VL3, VH1, VH2, and/or VH3 specifically binds to an HIV protein. In some aspects, the polypeptide has a structure represented by VH1-L1-VL2-L2-VL3-L3-VH3-L4-VH2-L5-VL1-L6-CL-CH1, wherein VL1, VL2, VL3, VH1, VH2, and/or VH3 specifically binds to an HIV protein. In some aspects, the polypeptide has a structure represented by VH1-L1-VL2-L2-VL3-L3-VH3-L4-VH2-L5-VL1-L6-CL-L7-CH1, wherein VL1, VL2, VL3, VH1, VH2, and/or VH3 specifically binds to an HIV protein. The HIV protein is as described herein. For the avoidance of doubt, all the antigen binding polypeptide structures described herein can be combined with any one or more of the HIV targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VH1, VH2, and/or VH3 of each and every antigen binding polypeptide and antigen binding polypeptide complex described herein may independently bind to any one of said particularly preferred targets.

In some aspects, the antigen binding polypeptide complex comprises a first polypeptide and a second polypeptide; wherein the first polypeptide has a structure represented by VL1-VL2-VL3-VH3-VH2-VH1-CH1; VL1-VL2-VL3-VH3-VH2-VH1-CL; VL1-VL2-VL3-VH3-VH2-VH1-CH1-CL; VL1-VL2-VL3-VH3-VH2-VH1-CL-CH1; VH1-VH2-VH3-VL3-VL2-VL1-CH1; VH1-VH2-VH3-VL3-VL2-VL1-CL; VH1-VH2-VH3-VL3-VL2-VL1-CH1-CL; VH1-VH2-VH3-VL3-VL2-VL1-CL-CH1; VL1-VH2-VL3-VH3-VL2-VH1-CH1; VL1-VH2-VL3-VH3-VL2-VH1-CL; VL1-VH2-VL3-VH3-VL2-VH1-CH1-CL; VL1-VH2-VL3-VH3-VL2-VH1-CL-CH1; VH1-VL2-VH3-VL3-VH2-VL1-CH1; VH1-VL2-VH3-VL3-VH2-VL1-CL; VH1-VL2-VH3-VL3-VH2-VL1-CL-CH1; VH1-VL2-VH3-VL3-VH2-VL1-CH1-CL; VH1-VL2-VH3-VL3-VH2-VL1-CL-CH1; VL1-VL2-VH3-VL3-VH2-VH1-CH1; VL1-VL2-VH3-VL3-VH2-VH1-CL; VL1-VL2-VH3-VL3-

VH2-VH1-CH1-CL; VL1-VL2-VH3-VL3-VH2-VH1-CL-CH1; VH1-VH2-VL3-VH3-VL2-VL1-CH1; VH1-VH2-VL3-VH3-VL2-VL1-CL; VH1-VH2-VL3-VH3-VL2-VL1-CH1-CL; VH1-VH2-VL3-VH3-VL2-VL1-CL-CH1; VL1-VH2-VH3-VL3-VL2-VH1-CH1; VL1-VH2-VH3-VL3-VL2-VH1-CL; VL1-VH2-VH3-VL3-VL2-VH1-CH1-CL; VL1-VH2-VH3-VL3-VL2-VH1-CL-CH1; VH1-VL2-VL3-VH3-VH2-VL1-CH1; VH1-VL2-VL3-VH3-VH2-VL1-CL; VH1-VL2-VL3-VH3-VH2-VL1-CH1-CL; VH1-VL2-VL3-VH3-VH2-VL1-CL-CH1; VL1-L1-VL2-L2-VL3-L3-VH3-L4-VH2-L5-VH1-CH1; VL1-L1-VL2-L2-VL3-L3-VH3-L4-VH2-L5-VH1-L6-CH1; VL1-L1-VL2-L2-VL3-L3-VH3-L4-VH2-L5-VH1-CL; VL1-L1-VL2-L2-VL3-L3-VH3-L4-VH2-L5-VH1-L6-CL; VL1-L1-VL2-L2-VL3-L3-VH3-L4-VH2-L5-VH1-CH1-CL; VL1-L1-VL2-L2-VL3-L3-VH3-L4-VH2-L5-VH1-L6-CH1-CL; VL1-L1-VL2-L2-VL3-L3-VH3-L4-VH2-L5-VH1-L6-CH1-L7-CH1; VL1-L1-VL2-L2-VL3-L3-VH3-L4-VH2-L5-VH1-CL-CH1; VL1-L1-VL2-L2-VL3-L3-VH3-L4-VH2-L5-VH1-L6-CL-CH1; VL1-L1-VL2-L2-VL3-L3-VH3-L4-VH2-L5-VH1-L6-CL-L7-CH1; VH1-L1-VH2-L2-VH3-L3-VL3-L4-VL2-L5-VL1-CH1; VH1-L1-VH2-L2-VH3-L3-VL3-L4-VL2-L5-VL1-L6-CH1; VH1-L1-VH2-L2-VH3-L3-VL3-L4-VL2-L5-VL1-CL; VH1-L1-VH2-L2-VH3-L3-VL3-L4-VL2-L5-VL1-L6-CL; VH1-L1-VH2-L2-VH3-L3-VL3-L4-VL2-L5-VL1-CH1-CL; VH1-L1-VH2-L2-VH3-L3-VL3-L4-VL2-L5-VL1-L6-CH1-CL; VH1-L1-VH2-L2-VH3-L3-VL3-L4-VL2-L5-VL1-L6-CH1-L7-CH1; VH1-L1-VH2-L2-VH3-L3-VL3-L4-VL2-L5-VL1-CL-CH1; VH1-L1-VH2-L2-VH3-L3-VL3-L4-VL2-L5-VL1-L6-CL-CH1; VH1-L1-VH2-L2-VH3-L3-VL3-L4-VL2-L5-VL1-L6-CL-L7-CH1; VL1-L1-VH2-L2-VL3-L3-VH3-L4-VL2-L5-VH1-CH1; VL1-L1-VH2-L2-VL3-L3-VH3-L4-VL2-L5-VH1-L6-CH1; VL1-L1-VH2-L2-VL3-L3-VH3-L4-VL2-L5-VH1-CL; VL1-L1-VH2-L2-VL3-L3-VH3-L4-VL2-L5-VH1-L6-CL; VL1-L1-VH2-L2-VL3-L3-VH3-L4-VL2-L5-VH1-CH1-CL; VL1-L1-VH2-L2-VL3-L3-VH3-L4-VL2-L5-VH1-L6-CH1-CL; VL1-L1-VH2-L2-VL3-L3-VH3-L4-VL2-L5-VH1-L6-CH1-L7-CH1; VH1-L1-VL2-L2-VL3-L3-VH3-L4-VH2-L5-VL1-CH1; VH1-L1-VL2-L2-VL3-L3-VH3-L4-VH2-L5-VL1-L6-CH1; VH1-L1-VL2-L2-VL3-L3-VH3-L4-VH2-L5-VL1-CL; VH1-L1-VL2-L2-VL3-L3-VH3-L4-VH2-L5-VL1-L6-CL; VH1-L1-VL2-L2-VL3-L3-VH3-L4-VH2-L5-VL1-CH1-CL; VH1-L1-VL2-L2-VL3-L3-VH3-L4-VH2-L5-VL1-L6-CH1-CL; VH1-L1-VL2-L2-VH3-L3-VL3-L4-VH2-L5-VL1-L6-CH1-L7-CH1; VH1-L1-VL2-L2-VH3-L3-VL3-L4-VH2-L5-VL1-CL-CH1; VH1-L1-VL2-L2-VH3-L3-VL3-L4-VH2-L5-VL1-L6-CL-CH1; VH1-L1-VL2-L2-VH3-L3-VL3-L4-VH2-L5-VL1-L6-CL-L7-CH1; VH1-L1-VH2-L2-VL3-L3-VH3-L4-VL2-L5-VL1-L6-CH1; VH1-L1-

VH2-L2-VL3-L3-VH3-L4-VL2-L5-VL1-CH1-CL; VH1-L1-VH2-L2-VL3-L3-VH3-L4-VL2-L5-VL1-L6-CH1-CL; VH1-L1-VH2-L2-VL3-L3-VH3-L4-VL2-L5-VL1-L6-CH1-L7-CL; VH1-L1-VH2-L2-VL3-L3-VH3-L4-VL2-L5-VL1-CL-CH1; VH1-L1-VH2-L2-VL3-L3-VH3-L4-VL2-L5-VL1-L6-CL-CH1; VH1-L1-VH2-L2-VL3-L3-VH3-L4-VL2-L5-VL1-L6-CL-L7-CH1; VL1-L1-VH2-L2-VH3-L3-VL3-L4-VL2-L5-VH1-CH1; VL1-L1-VH2-L2-VH3-L3-VL3-L4-VL2-L5-VH1-L6-CH1; VL1-L1-VH2-L2-VH3-L3-VL3-L4-VL2-L5-VH1-CL; VL1-L1-VH2-L2-VH3-L3-VL3-L4-VL2-L5-VH1-L6-CL; VL1-L1-VH2-L2-VH3-L3-VL3-L4-VL2-L5-VH1-CH1-CL; VL1-L1-VH2-L2-VH3-L3-VL3-L4-VL2-L5-VH1-L6-CH1-CL; VL1-L1-VH2-L2-VH3-L3-VL3-L4-VL2-L5-VH1-L6-CH1-L7-CL; VL1-L1-VH2-L2-VH3-L3-VL3-L4-VL2-L5-VH1-CL- CH1; VL1-L1-VH2-L2-VH3-L3-VL3-L4-VL2-L5-VH1-L6-CL-CH1; VL1-L1-VH2-L2-VH3-L3-VL3-L4-VL2-L5-VH1-L6-CL-L7-CH1; VH1-L1-VL2-L2-VL3-L3-VH3-L4-VH2-L5-VL1-CH1; VH1-L1-VL2-L2-VL3-L3-VH3-L4-VH2-L5-VL1-L6-CH1; VH1-L1-VL2-L2-VL3-L3-VH3-L4-VH2-L5-VL1-CL; VH1-L1-VL2-L2-VL3-L3-VH3-L4-VH2-L5-VL1-L6-CL; VH1-L1-VL2-L2-VL3-L3-VH3-L4-VH2-L5-VL1-CH1-CL; VH1-L1-VL2-L2-VL3-L3-VH3-L4-VH2-L5-VL1-L6-CH1-CL; VH1-L1-VL2-L2-VL3-L3-VH3-L4-VH2-L5-VL1-L6-CH1-L7-CH1; VH1-L1-VL2-L2-VL3-L3-VH3-L4-VH2-L5-VL1-CL-CH1; VH1-L1-VL2-L2-VL3-L3-VH3-L4-VH2-L5-VL1-L6-CL-CH1; or VH1-L1-VL2-L2-VL3-L3-VH3-L4-VH2-L5-VL1-L6-CL-L7-CH1;

wherein the second polypeptide has a structure represented by VL4-VH4-CH1; VL4-VH4-CL; VL4-VH4-CH1-CL; VL4-VH4-CL-CH1; VH4-VL4-CH1; VH4-VL4-CL; VH4-VL4-CH1-CL; VH4-VL4-CL-CH1; VL4-L8-VH4-CH1; VL4-L8-VH4-CL; VL4-L8-VH4-CH1-CL; VL4-L8-VH4-CL-CH1; VH4-L8-VL4-CH1; VH4-L8-VL4-CL; VH4-L8-VH4-CH1-CL; VH4-L8-VH4-CL-CH1; VL4-VL5-VH5-VH4-CH1; VL4-VL5-VH5-VH4-CL; VL4-VL5-VH5-VH4-CH1-CL; VL4-VL5-VH5-VH4-CL-CH1; VH4-VH5-VL5-VL4-CH1; VH4-VH5-VL5-VL4-CL; VH4-VH5-VL5-VL4-CH1-CL; VH4-VH5-VL5-VL4-CL-CH1; VL4-L8-VL5-L9-VH5-L10-VH4-CH1; VL4-L8-VL5-L9-VH5-L10-VH4-CL; VL4-L8-VL5-L9-VH5-L10-VH4-CH1-CL; VL4-L8-VL5-L9-VH5-L10-VH4-CL-CH1; VH4-L8-VH5-L9-VL5-L10-VL4-CH1; VH4-L8-VH5-L9-VL5-L10-VL4-CL; VH4-L8-VH5-L9-VL5-L10-VL4-CH1-CL; VH4-L8-VH5-L9-VL5-L10-VL4-CL-CH1; VL4-VL5-VL6-VH6-VH5-VH4-CH1; VL4-VL5-VL6-VH6-VH5-VH4-CL; VL4-VL5-VL6-VH6-VH5-VH4-CH1-CL; VL4-VL5-VL6-VH6-VH5-VH4-CL-CH1; VH4-VH5-VH6-VL6-VL5-VL4-CH1; VH4-VH5-VH6-VL6-VL5-VL4-CL; VH4-VH5-VH6-VL6-VL5-VL4-CH1-CL; VH4-VH5-VH6-VL6-VL5-VL4-CL-CH1; VL4-VH5-VL6-VH6-VL5-VH4-CH1; VL4-VH5-VL6-VH6-VL5-VH4-CL; VL4-VH5-VL6-VH6-VL5-VH4-CH1-CL; VL4-VH5-VL6-VH6-VL5-VH4-CL-CH1; VH4-VL5-VH6-VL6-VH5-VL4-CH1; VH4-VL5-VH6-VL6-VH5-VL4-CL; VH4-VL5-VH6-VL6-VH5-VL4-CH1-CL; VH4-VL5-VH6-VL6-VH5-VL4-CL-CH1; VL4-VL5-VH6-VL6-VH5-VH4-CH1; VL4-VL5-VH6-VL6-VH5-VH4-CL; VL4-VL5-VH6-VL6-VH5-VH4-CH1-CL; VL4-VL5-VH6-VL6-VH5-VH4-CL-CH1; VH4-VH5-VL6-VH6-VL5-VL4-CH1; VH4-VH5-VL6-VH6-VL5-VL4-CL; VH4-VH5-VL6-VH6-VL5-VL4-CH1-CL; VH4-VH5-VL6-VH6-VL5-VL4-CL-CH1; VL4-VH5-VL6-VH6-VL5-VH4-CH1; VL4-VH5-VH6-VL6-VH5-VH4-CL; VL4-VH5-VH6-VL6-VH5-VH4-CH1-CL; VL4-VH5-VH6-VL6-VH5-VL4-CL-CH1; VH4-VL5-VL6-VH6-VH5-VL4-CH1; VH4-VL5-VL6-VH6-VH5-VL4-CL; VH4-VL5-VL6-VH6-VH5-VL4-CH1-CL; VH4-VL5-VL6-

VH3-VH2-VL1-CH1; VH1-VL2-VL3-VH3-VH2-VL1-CL; VH1-VL2-VL3-VH3-VH2-VL1-CH1-CL; VH1-VL2-VL3-VH3-VH2-VL1-CL-CH1; VL1-L1-VL2-L2-VL3-L3-VH3-L4-VH2-L5-VH1-CH1; VL1-L1-VL2-L2-VL3-L3-VH3-L4-VH2-L5-VH1-L6-CH1; VL1-L1-VL2-L2-VL3-L3-VH3-L4-VH2-L5-VH1-CL; VL1-L1-VL2-L2-VL3-L3-VH3-L4-VH2-L5-VH1-L6-CL; VL1-L1-VL2-L2-VL3-L3-VH3-L4-VH2-L5-VH1-CH1-CL; VL1-L1-VL2-L2-VL3-L3-VH3-L4-VH2-L5-VH1-L6-CH1-CL; VL1-L1-VL2-L2-VL3-L3-VH3-L4-VH2-L5-VH1-L6-CH1-L7-CH1; VL1-L1-VL2-L2-VL3-L3-VH3-L4-VH2-L5-VH1-CL-CH1; VL1-L1-VL2-L2-VL3-L3-VH3-L4-VH2-L5-VH1-L6-CL-CH1; VL1-L1-VL2-L2-VL3-L3-VH3-L4-VH2-L5-VH1-L6-CL-L7-CH1; VH1-L1-VH2-L2-VH3-L3-VL3-L4-VL2-L5-VL1-CH1; VH1-L1-VH2-L2-VH3-L3-VL3-L4-VL2-L5-VL1-L6-CH1; VH1-L1-VH2-L2-VH3-L3-VL3-L4-VL2-L5-VL1-CL; VH1-L1-VH2-L2-VH3-L3-VL3-L4-VL2-L5-VL1-L6-CL; VH1-L1-VH2-L2-VH3-L3-VL3-L4-VL2-L5-VL1-CH1-CL; VH1-L1-VH2-L2-VH3-L3-VL3-L4-VL2-L5-VL1-L6-CH1-CL; VH1-L1-VH2-L2-VH3-L3-VL3-L4-VL2-L5-VL1-L6-CH1-L7-CH1; VH1-L1-VH2-L2-VH3-L3-VL3-L4-VL2-L5-VL1-CL-CH1; VH1-L1-VH2-L2-VH3-L3-VL3-L4-VL2-L5-VL1-L6-CL-CH1; VH1-L1-VH2-L2-VH3-L3-VL3-L4-VL2-L5-VL1-L6-CL-L7-CH1; VL1-L1-VL2-L2-VH3-L3-VL3-L4-VH2-L5-VL1-CH1; VL1-L1-VL2-L2-VH3-L3-VL3-L4-VH2-L5-VL1-L6-CH1; VL1-L1-VL2-L2-VH3-L3-VL3-L4-VH2-L5-VL1-CL; VL1-L1-VL2-L2-VH3-L3-VL3-L4-VH2-L5-VL1-L6-CL; VL1-L1-VL2-L2-VH3-L3-VL3-L4-VH2-L5-VL1-CH1-CL; VL1-L1-VL2-L2-VH3-L3-VL3-L4-VH2-L5-VL1-L6-CH1-CL; VL1-L1-VL2-L2-VH3-L3-VL3-L4-VH2-L5-VL1-L6-CH1-L7-CH1; VL1-L1-VL2-L2-VH3-L3-VL3-L4-VH2-L5-VL1-CL-CH1; VL1-L1-VL2-L2-VH3-L3-VL3-L4-VH2-L5-VL1-L6-CL-CH1; VH1-L1-VL2-L2-VH3-L3-VL3-L4-VH2-L5-VL1-L6-CL-L7-CH1; VH1-L1-VH2-L2-VL3-L3-VH3-L4-VL2-L5-VL1-CH1; VH1-L1-VH2-L2-VL3-L3-VH3-L4-VL2-L5-VL1-L6-CH1; VH1-L1-VL2-L2-VL3-L3-VH3-L4-VH2-L5-VL1-CL; VH1-L1-VL2-L2-VL3-L3-VH3-L4-VH2-L5-VL1-L6-CH1; VH1-L1-VL2-L2-VH3-L3-VL3-L4-VH2-L5-VL1-CL; VH1-L1-VH2-L2-VL3-L3-VH3-L4-VL2-L5-VL1-L6-CL;

VH6-VH5-VL4-CL-CH1; VL4-L8-VL5-L9-VL6-L10-VH6-L11-VH5-L12-VH4-CH1; VL4-L8-VL5-L9-VL6-L10-VH6-L11-VH5-L12-VH4-CL; VL4-L8-VL5-L9-VL6-L10-VH6-L11-VH5-L12-VH4-CH1-CL; VL4-L8-VL5-L9-VL6-L10-VH6-L11-VH5-L12-VH4-CL-CH1; VH4-L8-VH5-L9-VH6-L10-VL6-L11-VL5-L12-VL4-CH1; VH4-L8-VH5-L9-VH6-L10-VL6-L11-VL5-L12-VL4-CL; VH4-L8-VH5-L9-VH6-L10-VL6-L11-VL5-L12-VL4-CH1-CL; VH4-L8-VH5-L9-VH6-L10-VL6-L11-VL5-L12-VL4-CL-CH1; VL4-L8-VH5-L9-VL6-L10-VH6-L11-VL5-L12-VH4-CH1; VL4-L8-VH5-L9-VL6-L10-VH6-L11-VL5-L12-VH4-CL; VL4-L8-VH5-L9-VL6-L10-VH6-L11-VL5-L12-VH4-CH1-CL; VL4-L8-VH5-L9-VL6-L10-VH6-L11-VL5-L12-VH4-CL-CH1; VH4-L8-VL5-L9-VH6-L10-VL6-L11-VH5-L12-VL4-CH1; VH4-L8-VL5-L9-VH6-L10-VL6-L11-VH5-L11-VL4-CL; VH4-L8-VL5-L9-VH6-L10-VL6-L11-VH5-L12-VL4-CH1-CL; VH4-L8-VL5-L9-VH6-L10-VL6-L11-VH5-L12-VL4-CL-CH1; VL4-L8-VL5-L9-VL6-L10-VH6-L11-VH5-L12-VH4-L13-CH1; VL4-L8-VL5-L9-VL6-L10-VH6-L11-VH5-L12-VH4-L13-CL; VL4-L8-VL5-L9-VL6-L10-VH6-L11-VH5-L12-VH4-L13-CH1-CL; VL4-L8-VL5-L9-VL6-L10-VH6-L11-VH5-L12-VH4-L13-CL-CH1; VH4-L8-VH5-L9-VH6-L10-VL6-L11-VL5-L12-VL4-L13-CH1; VH4-L8-VH5-L9-VH6-L10-VL6-L11-VL5-L12-VL4-L13-CL; VH4-L8-VH5-L9-VH6-L10-VL6-L11-VL5-L12-VL4-L13-CH1-CL; VH4-L8-VH5-L9-VH6-L10-VL6-L11-VL5-L12-VL4-L13-CL-CH1; VL4-L8-VH5-L9-VL6-L10-VH6-L11-VL5-L12-VH4-L13-CH1; VL4-L8-VH5-L9-VL6-L10-VH6-L11-VL5-L12-VH4-L13-CL; VL4-L8-VH5-L9-VL6-L10-VH6-L11-VL5-L12-VH4-L13-CH1-CL; VL4-L8-VH5-L9-VL6-L10-VH6-L11-VL5-L12-VH4-L13-CL-CH1; VH4-L8-VL5-L9-VH6-L10-VL6-L11-VH5-L12-VL4-L13-CH1; VH4-L8-VL5-L9-VH6-L10-VL6-L11-VH5-L12-VL4-L13-CL; VH4-L8-VL5-L9-VH6-L10-VL6-L11-VH5-L12-VL4-L13-CH1-CL; VH4-L8-VL5-L9-VH6-L10-VL6-L11-VH5-L12-VL4-L13-CL-CH1; VL4-L8-VH5-L9-VL6-L10-VH6-L11-VL5-L12-VH4-L13-CH1; VL4-L8-VH5-L9-VL6-L10-VH6-L11-VL5-L12-VH4-L13-CL; VL4-L8-VH5-L9-VL6-L10-VH6-L11-VL5-L12-VH4-CH1; VL4-L8-VL5-L9-VH6-L10-VL6-L11-VH5-L12-VH4-CL; VL4-L8-VL5-L9-VH6-L10-VL6-L11-VH5-L12-VH4-CH1-CL; VL4-L8-VL5-L9-VH6-L10-VL6-L11-VH5-L12-VH4-CL-CH1; VH4-L8-VH5-L9-VL6-L10-VH6-L11-VL5-L12-VL4-CH1; VH4-L8-VH5-L9-VL6-L10-VH6-L11-VL5-L12-VL4-CL; VH4-L8-VH5-L9-VL6-L10-VH6-L11-VL5-L12-VL4-CH1-CL; VH4-L8-VH5-L9-VL6-L10-VH6-L11-VL5-L12-VL4-CL-CH1; VL4-L8-VL5-L9-VH6-L10-VL6-L11-VH5-L12-VH4-L13-CH1; VL4-L8-VL5-L9-VH6-L10-VL6-L11-VH5-L12-VH4-L13-CL; VL4-L8-VL5-L9-VH6-L10-VL6-L11-VH5-L12-VH4-L13-CH1-CL; VH4-L8-VH5-L9-VL6-L10-VH6-L11-VL5-L12-VL4-L13-CH1; VH4-L8-VH5-L9-VL6-L10-VH6-L11-VL5-L12-VL4-L13-CL; VH4-L8-VH5-L9-VL6-L10-VH6-L11-VL5-L12-VL4-L13-CH1-CL; or VH4-L8-VH5-L9-VL6-L10-VH6-L11-VL5-L12-VL4-L13-CL-CH1; wherein VL1 is a first immunoglobulin light chain variable region that specifically binds to an HIV protein; VL2 is a second immunoglobulin light chain variable region that specifically binds to an HIV protein; VL3 is a third immunoglobulin light chain variable region that specifically binds to an HIV protein; VL4 is a fourth immunoglobulin light chain variable region that specifically binds to an HIV protein; VL5 is a fifth immunoglobulin light chain variable region that specifically binds to an HIV protein; VL6 is a sixth immunoglobulin light chain variable region that specifically binds to an HIV protein; VH1 is a first immunoglobulin heavy chain variable region that specifically binds to an HIV protein; VH2 is a second immunoglobulin heavy chain variable region that specifically binds to an HIV protein; VH3 is a third immunoglobulin heavy chain variable region that specifically binds to an HIV protein; VH4 is a fourth immunoglobulin heavy chain variable region that specifically binds to an HIV protein; VH5 is a fifth immunoglobulin heavy chain variable region that specifically binds to an HIV protein; VH6 is a sixth immunoglobulin heavy chain variable region that specifically binds to an HIV protein; CH1 is a heavy chain constant region 1; CL is a light chain constant region; and L1, L2, L3, L4, L5, L6, L7, L8, L9, L10, L11, L12 and L13 are amino acid linkers. For the avoidance of doubt, all the antigen binding polypeptide structures described herein can be combined with any one or more of the HIV targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VL4, VL5, VL6, VH1, VH2, VH3, VH4, VH5 and/or VH6 of each and every antigen binding polypeptide and antigen binding polypeptide complex described herein may independently bind to any one of said particularly preferred targets.

In some aspects, the antigen binding polypeptide complex comprises a first polypeptide and a second polypeptide; wherein the first polypeptide has a structure represented by VL1-VL2-VL3-VH3-VH2-VH1-CH1-Fc; VH1-VH2-VH3-VL3-VL2-VL1-CH1-Fc; VL1-VH2-VL3-VH3-VL2-VH1-CH1-Fc; VH1-VL2-VH3-VL3-VH2-VL1-CH1-Fc; VL1-VL2-VH3-VL3-VH2-VH1-CH1-Fc; VH1-VH2-VL3-VH3-VL2-VL1-CH1-Fc; VL1-VH2-VH3-VL3-VL2-VH1-CH1-Fc; VH1-VL2-VL3-VH3-VH2-VL1-CH1-Fc; VL1-VL2-VL3-VH3-VH2-VH1-CL-Fc; VH1-VH2-VH3-VL3-VL2-VL1-CL-Fc; VL1-VH2-VL3-VH3-VL2-VH1-CL-Fc; VH1-VL2-VH3-VL3-VH2-VL1-CL-Fc; VL1-VL2-VH3-VL3-VH2-VH1-CL-Fc; VH1-VH2-VL3-VH3-VL2-VL1-CL-Fc; VL1-VH2-VH3-VL3-VL2-VH1-CL-Fc; VH1-VL2-VL3-VH3-VH2-VL1-CH1-CL-Fc; VL1-VH2-VL3-VH3-VL2-VH1-CH1-CL-Fc; VH1-VL2-VH3-VL3-VH2-VL1-CH1-CL-Fc; VL1-VL2-VH3-VL3-VH2-VH1-CH1-CL-Fc; VH1-VH2-VL3-VH3-VL2-VL1-CH1-CL-Fc; VL1-VH2-VH3-VL3-VL2-VH1-CH1-CL-Fc; VH1-VL2-VL3-VH3-VH2-VL1-CH1-CL-Fc; VL1-VL2-VL3-VH3-VH2-VH1-CL-CH1-Fc; VH1-VH2-VH3-VL3-VL2-VL1-CL-CH1-Fc; VL1-VH2-VL3-VH3-VL2-VH1-CL-CH1-Fc; VH1-VL2-VH3-VL3-VH2-VL1-CL-CH1-Fc; VL1-VL2-VH3-VL3-VH2-VH1-CL-CH1-Fc; VH1-VH2-VL3-VH3-VL2-VL1-CL-CH1-Fc; VL1-VH2-VH3-VL3-VL2-VH1-CL-CH1-Fc; VH1-VL2-VL3-VH3-VH2-VL1-CL-CH1-Fc; VL1-L1-VL2-L2-VL3-L3-VH3-L4-VH2-L5-VH1-CH1-Fc; VH1-L1-VH2-L2-VH3-L3-VL3-L4-VL2-L5-VL1-CH1-Fc; VL1-L1-VH2-L2-VL3-L3-VH3-L4-VL2-L5-VH1-CH1-Fc; VH1-L1-VL2-L2-VH3-L3-VL3-L4-VH2-L5-VL1-CH1-Fc; VL1-L1-VL2-L2-VH3-L3-VL3-L4-VH2-L5-VH1-CH1-Fc; VH1-L1-VH2-L2-VL3-L3-VH3-L4-VL2-L5-VL1-CH1-Fc; VL1-L1-VH2-L2-VH3-L3-VL3-L4-VL2-L5-VH1-CH1-Fc; VH1-L1-VL2-L2-VL3-L3-VH3-L4-VH2-L5-VL1-CH1-Fc; VL1-L1-VL2-L2-VL3-L3-VH3-L4-VH2-L5-VH1-CL-Fc; VH1-L1-VH2-L2-VH3-L3-VL3-L4-VL2-L5-VL1-CL-Fc; VL1-L1-VH2-L2-VL3-L3-VH3-L4-VL2-L5-VH1-CL-Fc; VH1-L1-VL2-L2-VH3-L3-VL3-L4-VH2-L5-VL1-CL-Fc; VL1-L1-VL2-L2-VH3-L3-VL3-L4-VH2-L5-VH1-CL-Fc; VH1-L1-VH2-L2-VL3-L3-VH3-L4-VL2-L5-VL1-CL-Fc; VL1-L1-VH2-L2-VH3-L3-VL3-L4-VL2-L5-VH1-CL-Fc; VH1-L1-

VL2-L2-VL3-L3-VH3-L4-VH2-L5-VL1-CL-Fc; VL1-L1-VL2-L2-VL3-L3-VH3-L4-VH2-L5-VH1-CH1-CL-Fc; VH1-L1-VH2-L2-VH3-L3-VL3-L4-VL2-L5-VL1-CH1-CL-Fc; VL1-L1-VH2-L2-VH3-L3-VH3-L4-VL2-L5-VH1-CH1-CL-Fc; VH1-L1-VL2-L2-VH3-L3-VL3-L4-VH2-L5-VL1-CH1-CL-Fc;    VL1-L1-VL2-L2-VH3-L3-VL3-L4-VH2-L5-VH1-CH1-CL-Fc;    VH1-L1-VH2-L2-VL3-L3-VH3-L4-VL2-L5-VL1-CH1-CL-Fc;    VL1-L1-VH2-L2-VH3-L3-VL3-L4-VL2-L5-VH1-CH1-CL-Fc;    VH1-L1-VL2-L2-VL3-L3-VH3-L4-VH2-L5-VL1-CH1-CL-Fc; VL1-L1-VL2-L2-VL3-L3-VH3-L4-VH2-L5-VH1-CL-CH1-Fc;    VH1-L1-VH2-L2-VH3-L3-VL3-L4-VL2-L5-VL1-CL-CH1-Fc;    VL1-L1-VH2-L2-VH3-L3-VH3-L4-VL2-L5-VH1-CL-CH1-Fc;    VH1-L1-VL2-L2-VH3-L3-VL3-L4-VH2-L5-VL1-CL-CH1-Fc;    VL1-L1-VL2-L2-VH3-L3-VL3-L4-VH2-L5-VH1-CL-CH1-Fc;    VH1-L1-VH2-L2-VL3-L3-VH3-L4-VL2-L5-VL1-CL-CH1-Fc;    VL1-L1-VH2-L2-VH3-L3-VL3-L4-VL2-L5-VH1-CL-CH1-Fc;  or  VH1-L1-VL2-L2-VL3-L3-VH3-L4-VH2-L5-VL1-CL-CH1-Fc; wherein the second polypeptide has a structure represented by Fc; VL4-VH4-CH1-Fc; VL4-VH4-CL-Fc;   VL4-VH4-CH1-CL-Fc;   VL4-VH4-CL-CH1-Fc; VH4-VL4-CH1-Fc; VH4-VL4-CL-Fc; VH4-VL4-CH1-CL-Fc; VH4-VL4-CL-CH1-Fc; VL4-L6-VH4-CH1-Fc; VL4-L6-VH4-CL-Fc; VL4-L6-VH4-CH1-CL-Fc; VL4-L6-VH4-CL-CH1-Fc; VH4-L6-VL4-CH1-Fc; VH4-L6-VL4-CL-Fc; VH4-L6-VL4-CH1-CL-Fc;    VH4-L6-VL4-CL-CH1-Fc; VL4-CL-VH4-CH1-Fc; VH4-CL-VL4-CH1-Fc; VL4-CH1-VH4-CL-Fc;    VH4-CH1-VL4-CL-Fc;    VL4-L6-CL-L7-VH4-L8-CH1-Fc;    VL4-L6-CL-L7-VH4-L8-CH1-L9-Fc; VH4-L6-CL-L7-VL4-L8-CH1-Fc;    VH4-L6-CL-L7-VL4-L8-CH1-L9-Fc; VL4-L6-CH1-L7-VH4-L8-CL-Fc; VL4-L6-CH1-L7-VH4-L8-CL-L9-Fc;    VH4-L6-CH1-L7-VL4-L8-CL-Fc; VH4-L6-CH1-L7-VL4-L8-CL-L9-Fc; VL4-VL5-VH5-VH4-CH1-Fc;    VL4-VL5-VH5-VH4-CL-Fc; VL4-VL5-VH5-VH4-CH1-CL-Fc; VL4-VL5-VH5-VH4-CL-CH1-Fc; VH4-VH5-VL5-VL4-CH1-Fc; VH4-VH5-VL5-VL4-CL-Fc; VH4-VH5-VL5-VL4-CH1-CL-Fc; VH4-VH5-VL5-VL4-CL-CH1-Fc; VL4-L6-VL5-L7-VH5-L8-VH4-CH1-Fc;    VL4-L6-VL5-L7-VH5-L8-VH4-CL-Fc; VL4-L6-VL5-L7-VH5-L8-VH4-CH1-CL-Fc;    VL4-L6-VL5-L7-VH5-L8-VH4-CL-CH1-Fc;    VH4-L6-VH5-L7-VL5-L8-VL4-CH1-Fc;    VH4-L6-VH5-L7-VL5-L8-VL4-CL-Fc; VH4-L6-VH5-L7-VL5-L8-VL4-CH1-CL-Fc; VH4-L6-VH5-L7-VL5-L8-VL4-CL-CH1-Fc;    VL4-VL5-VL6-VH6-VH5-VH4-CH1-Fc; VL4-VL5-VL6-VH6-VH5-VH4-CL-Fc; VL4-VL5-VL6-VH6-VH5-VH4-CH1-CL-Fc; VL4-VL5-VL6-VH6-VH5-VH4-CL-CH1-Fc;   VH4-VH5-VH6-VL6-VL5-VL4-CH1-Fc; VH4-VH5-VH6-VL6-VL5-VL4-CL-Fc; VH4-VH5-VH6-VL6-VL5-VL4-CH1-CL-Fc; VH4-VH5-VH6-VL6-VL5-VL4-CL-CH1-Fc;   VL4-VH5-VL6-VH6-VL5-VH4-CH1-Fc; VL4-VH5-VL6-VH6-VL5-VH4-CL-Fc; VL4-VH5-VL6-VH6-VL5-VH4-CH1-CL-Fc; VL4-VH5-VL6-VH6-VL5-VH4-CL-CH1-Fc;    VH4-VL5-VH6-VL6-VH5-VL4-CH1-Fc; VH4-VL5-VH6-VL6-VH5-VL4-CL-Fc; VH4-VL5-VH6-VL6-VH5-VL4-CH1-CL-Fc; VH4-VL5-VH6-VL6-VH5-VL4-CL-CH1-Fc;    VL4-VL5-VH6-VL6-VH5-VH4-CH1-Fc; VL4-VL5-VH6-VL6-VH5-VH4-CL-Fc; VL4-VL5-VH6-VL6-VH5-VH4-CH1-CL-Fc; VL4-VH5-VH6-VL6-VL5-VH4-CL-CH1-Fc; VH4-VL5-VL6-VH6-VH5-VL4-CH1-Fc; VH4-VL5-VL6-

CL-Fc; VH4-VL5-VL6-VH6-VH5-VL4-CH1-CL-Fc; VH4-VL5-VL6-VH6-VH5-VL4-CL-CH1-Fc; VL4-L6-VL5-L7-VL6-L8-VH6-L9-VH5-L10-VH4-CH1-Fc; VL4-L6-VL5-L7-VL6-L8-VH6-L9-VH5-L10-VH4-CL-Fc;    VL4-L6-VL5-L7-VL6-L8-VH6-L9-VH5-L10-VH4-CH1-CL-Fc; VL4-L6-VL5-L7-VL6-L8-VH6-L9-VH5-L10-VH4-CL-CH1-Fc;    VH4-L6-VH5-L7-VH6-L8-VL6-L9-VL5-L10-VL4-CH1-Fc;    VH4-L6-VH5-L7-VH6-L8-VL6-L9-VL5-L10-VL4-CL-Fc;    VH4-L6-VH5-L7-VH6-L8-VL6-L9-VL5-L10-VL4-CH1-CL-Fc;    VH4-L6-VH5-L7-VH6-L8-VL6-L9-VL5-L10-VL4-CL-CH1-Fc;    VL4-L6-VH5-L7-VL6-L8-VH6-L9-VL5-L10-VH4-CH1-Fc; VL4-L6-VH5-L7-VL6-L8-VH6-L9-VL5-L10-VH4-CL-Fc;    VL4-L6-VH5-L7-VL6-L8-VH6-L9-VL5-L10-VH4-CH1-CL-Fc; VL4-L6-VH5-L7-VL6-L8-VH6-L9-VL5-L10-VH4-CL-CH1-Fc;    VH4-L6-VL5-L7-VH6-L8-VL6-L9-VH5-L10-VL4-CH1-Fc;    VH4-L6-VL5-L7-VH6-L8-VL6-L9-VH5-L10-VL4-CL- Fc;    VH4-L6-VL5-L7-VH6-L8-VL6-L9-VH5-L10-VL4-CH1-CL-Fc;    VH4-L6-VL5-L7-VH6-L8-VL6-L9-VH5-L10-VL4-CL-CH1-Fc;    VL4-L6-VL5-L7-VH6-L8-VL6-L9-VH5-L10-VH4-CH1-Fc;    VL4-L6-VL5-L7-VH6-L8-VL6-L9-VH5-L10-VH4-CL-Fc;    VL4-L6-VL5-L7-VH6-L8-VL6-L9-VH5-L10-VH4-CH1-CL-Fc;    VL4-L6-VL5-L7-VH6-L8-VL6-L9-VH5-L10-VH4-CL-CH1-Fc;    VH4-L6-VH5-L7-VL6-L8-VH6-L9-VL5-L10-VL4-CH1-Fc;    VH4-L6-VH5-L7-VL6-L8-VH6-L9-VL5-L10-VL4-CL-Fc;    VH4-L6-VH5-L7-VL6-L8-VH6-L9-VL5-L10-VL4-CH1-CL-Fc;    VH4-L6-VH5-L7-VL6-L8-VH6-L9-VL5-L10-VL4-CL-CH1-Fc;    VL4-L6-VH5-L7-VH6-L8-VL6-L9-VL5-L10-VH4-CH1-Fc;    VL4-L6-VH5-L7-VH6-L8-VL6-L9-VL5-L10-VH4-CL-Fc;    VL4-L6-VH5-L7-VH6-L8-VL6-L9-VL5-L10-VH4-CH1-CL-Fc;    VL4-L6-VH5-L7-VH6-L8-VL6-L9-VL5-L10-VH4-CL-CH1-Fc;    VH4-L6-VL5-L7-VL6-L8-VH6-L9-VH5-L10-VL4-CH1-Fc;    VH4-L6-VL5-L7-VL6-L8-VH6-L9-VH5-L10-VL4-CL-Fc;    VH4-L6-VL5-L7-VL6-L8-VH6-L9-VH5-L10-VL4-CH1-CL-Fc;    VL4-L6-VL5-L7-VL6-L8-VH6-L9-VH5-L10-VH4-L11-CH1-Fc;    VL4-L6-VL5-L7-VL6-L8-VH6-L9-VH5-L10-VH4-L11-CL-Fc;    VL4-L6-VL5-L7-VL6-L8-VH6-L9-VH5-L10-VH4-L11-CH1-CL-Fc;    VL4-L6-VL5-L7-VL6-L8-VH6-L9-VH5-L10-VH4-L11-CL-CH1-Fc; VH4-L6-VH5-L7-VH6-L8-VL6-L9-VL5-L10-VL4-L11-CH1-Fc;    VH4-L6-VH5-L7-VH6-L8-VL6-L9-VL5-L10-VL4-L11-CL-Fc;    VH4-L6-VH5-L7-VH6-L8-VL6-L9-VL5-L10-VL4-L11-CH1-CL-Fc;    VH4-L6-VH5-L7-VH6-L8-VL6-L9-VL5-L10-VL4-L11-CL-CH1-Fc;    VL4-L6-VH5-L7-VL6-L8-VH6-L9-VL5-L10-VH4-L11-CH1-Fc;    VL4-L6-VH5-L7-VL6-L8-VH6-L9-VL5-L10-VH4-L11-CL-Fc;    VL4-L6-VH5-L7-VL6-L8-VH6-L9-VL5-L10-VH4-L11-CH1-CL-Fc;    VL4-L6-VH5-L7-VL6-L8-VH6-L9-VL5-L10-VH4-L11-CL-CH1-Fc;    VH4-L6-VL5-L7-VH6-L8-VL6-L9-VH5-L10-VL4-L11-CH1-Fc;    VH4-L6-VL5-L7-VH6-L8-VL6-L9-VH5-L10-VL4-L11-CL-Fc;    VH4-L6-VL5-L7-VH6-L8-VL6-L9-VH5-L10-VL4-L11-CH1-CL-Fc;    VH4-L6-VL5-L7-VH6-L8-VL6-L9-VH5-L10-VL4-L11-CL-CH1-Fc;    VL4-L6-VL5-L7-VH6-L8-VL6-L9-VH5-L10-VH4-L11-CH1-Fc;    VL4-L6-VL5-L7-VH6-L8-VL6-L9-VH5-L10-VH4-L11-CL-Fc;    VL4-L6-VL5-L7-VH6-L8-VL6-L9-VH5-L10-VH4-L11-CH1-CL-Fc;    VL4-L6-VL5-L7-VH6-L8-VL6-L9-VH5-L10-VH4-L11-CL-CH1-Fc;    VH4-L6-VH5-L7-VL6-L8-VH6-L9-VL5-L10-VL4-L11-CH1-Fc;    VH4-L6-VH5-L7-VL6-L8-VH6-L9-VL5-L10-VL4-L11-CL-Fc;    VH4-L6-VH5-L7-VL6-L8-VH6-L9-VL5-L10-VL4-L11-CH1-CL-Fc;    VH4-L6-VH5-L7-VL6-L8-VH6-L9-VL5-L10-VL4-L11-CL-CH1-Fc;    VL4-L6-VH5-L7-

VH6-L8-VL6-L9-VL5-L10-VH4-L11-CH1-Fc; VL4-L6-
VH5-L7-VH6-L8-VL6-L9-VL5-L10-VH4-L11-CL-Fc;
VL4-L6-VH5-L7-VH6-L8-VL6-L9-VL5-L10-VH4-L11-
CH1-CL-Fc; VL4-L6-VH5-L7-VH6-L8-VL6-L9-VL5-
L10-VH4-L11-CL-CH1-Fc; VH4-L6-VL5-L7-VL6-L8-
VH6-L9-VH5-L10-VL4-L11-CH1-Fc; VH4-L6-VL5-L7-
VL6-L8-VH6-L9-VH5-L10-VL4-L11-CL-Fc; VH4-L6-
VL5-L7-VL6-L8-VH6-L9-VH5-L10-VL4-L11-CH1-CL-
Fc; or VH4-L6-VL5-L7-VL6-L8-VH6-L9-VH5-L10-VL4-
L11-CL-CH1-Fc; wherein VL1 is a first immunoglobulin
light chain variable region that specifically binds to an HIV
protein; VL2 is a second immunoglobulin light chain vari-
able region that specifically binds to an HIV protein; VL3 is
a third immunoglobulin light chain variable region that
specifically binds to an HIV protein; VL4 is a fourth
immunoglobulin light chain variable region that specifically
binds to an HIV protein; VL5 is a fifth immunoglobulin light
chain variable region that specifically binds to an HIV
protein; VL6 is a sixth immunoglobulin light chain variable
region that specifically binds to an HIV protein; VH1 is a
first immunoglobulin heavy chain variable region that spe-
cifically binds to an HIV protein; VH2 is a second immu-
noglobulin heavy chain variable region that specifically
binds to an HIV protein; VH3 is a third immunoglobulin
heavy chain variable region that specifically binds to an HIV
protein; VH4 is a fourth immunoglobulin heavy chain
variable region that specifically binds to an HIV protein;
VH5 is a fifth immunoglobulin heavy chain variable region
that specifically binds to an HIV protein; VH6 is a sixth
immunoglobulin heavy chain variable region that specifi-
cally binds to an HIV protein; Fc is a region comprising an
immunoglobulin heavy chain constant region 2 (CH2), an
immunoglobulin heavy chain constant region 3 (CH3), and
optionally, an immunoglobulin hinge; CH1 is a heavy chain
constant region 1; CL is a light chain constant region; and
L1, L2, L3, L4, L5, L6, L7, L8, L9, L10 and L11 are amino
acid linkers. For the avoidance of doubt, all the antigen
binding polypeptide structures described herein can be com-
bined with any one or more of the HIV targets described
herein. Any and all disclosure herein in relation to targets for
antigen binding polypeptides of the invention is generally
applicable, and applies equally and without reservation to
each and every antigen binding polypeptide and antigen
binding polypeptide complex described herein. For the
avoidance of doubt, the VL1, VL2, VL3, VL4, VL5, VL6,
VH1, VH2, VH3, VH4, VH5 and/or VH6 of each and every
antigen binding polypeptide and antigen binding polypep-
tide complex described herein may independently bind to
any one of said particularly preferred targets.

In some aspects, the invention is directed to an antigen
binding polypeptide or antigen binding polypeptide complex
comprising a polypeptide having a structure represented by
VL1-VL2-VL3-VH3-VH2-VH1-CH3-CH3; VH1-VH2-
VH3-VL3-VL2-VL1-CH3-CH3; VL1-VH2-VL3-VH3-
VL2-VH1-CH3-CH3; VH1-VL2-VH3-VL3-VH2-VL1-
CH3-CH3; VL1-VL2-VH3-VL3-VH2-VH1-CH3-CH3;
VH1-VH2-VL3-VH3-VL2-VL1-CH3-CH3; VL1-VH2-
VH3-VL3-VL2-VH1-CH3-CH3; VH1-VL2-VL3-VH3-
VH2-VL1-CH3-CH3; VL1-L1-VL2-L2-VL3-L3-VH3-L4-
VH2-L5-VH1-CH3-CH3; VH1-L1-VH2-L2-VH3-L3-VL3-
L4-VL2-L5-VL1-CH3-CH3; VL1-L1-VH2-L2-VL3-L3-
VH3-L4-VL2-L5-VH1-CH3-CH3; VH1-L1-VL2-L2-VH3-
L3-VL3-L4-VH2-L5-VL1-CH3-CH3; VL1-L1-VL2-L2-
VH3-L3-VL3-L4-VH2-L5-VH1-CH3-CH3; VH1-L1-
L1-VL2-L2-VL3-L3-VH3-L4-VH2-L5-VL1-CH3-CH3;

VL1-L1-VL2-L2-VL3-L3-VH3-L4-VH2-L5-VH1-L6-
CH3-CH3; VH1-L1-VH2-L2-VH3-L3-VL3-L4-VL2-L5-
VL1-L6-CH3-CH3; VL1-L1-VH2-L2-VL3-L3-VH3-L4-
VL2-L5-VH1-L6-CH3-CH3; VH1-L1-VL2-L2-VH3-L3-
VL3-L4-VH2-L5-VL1-L6-CH3-CH3; VL1-L1-VL2-L2-
VH3-L3-VL3-L4-VH2-L5-VH1-L6-CH3-CH3; VH1-L1-
VH2-L2-VL3-L3-VH3-L4-VL2-L5-VL1-L6-CH3-CH3;
VL1-L1-VH2-L2-VH3-L3-VL3-L4-VL2-L5-VH1-L6-
CH3-CH3; VH1-L1-VL2-L2-VL3-L3-VH3-L4-VH2-L5-
VL1-L6-CH3-CH3; VL1-L1-VL2-L2-VL3-L3-VH3-L4-
VH2-L5-VH1-L6-CH3-L7-CH3; VH1-L1-VH2-L2-VH3-
L3-VL3-L4-VL2-L5-VL1-L6-CH3-L7-CH3; VL1-L1-
VH2-L2-VL3-L3-VH3-L4-VL2-L5-VH1-L6-CH3-L7-
CH3; VH1-L1-VL2-L2-VH3-L3-VL3-L4-VH2-L5-VL1-
L6-CH3-L7-CH3; VL1-L1-VL2-L2-VH3-L3-VL3-L4-
VH2-L5-VH1-L6-CH3-L7-CH3; VH1-L1-VH2-L2-VL3-
L3-VH3-L4-VL2-L5-VL1-L6-CH3-L7-CH3; VL1-L1-
VH2-L2-VH3-L3-VL3-L4-VL2-L5-VH1-L6-CH3-L7-
CH3; or VH1-L1-VL2-L2-VL3-L3-VH3-L4-VH2-L5-VL1-
L6-CH3-L7-CH3; wherein VL1 is a first immunoglobulin
light chain variable region that specifically binds to an HIV
protein; VL2 is a second immunoglobulin light chain vari-
able region that specifically binds to an HIV protein; VL3 is
a third immunoglobulin light chain variable region that
specifically binds to an HIV protein; VH1 is a first immu-
noglobulin heavy chain variable region that specifically
binds to an HIV protein; VH2 is a second immunoglobulin
heavy chain variable region that specifically binds to an HIV
protein; VH3 is a third immunoglobulin heavy chain vari-
able region that specifically binds to an HIV protein; CH3 is
an immunoglobulin heavy chain constant region 3; and L1,
L2, L3, L4, L5, L6 and L7 are amino acid linkers. In some
aspects, the polypeptide has a structure represented by
VL1-VL2-VL3-VH3-VH2-VH1-CH3-CH3, wherein VL1,
VL2, VL3, VH1, VH2, and/or VH3 specifically binds to an
HIV protein. In some aspects, the polypeptide has a structure
represented by VH1-VH2-VH3-VL3-VL2-VL1-CH3-CH3,
wherein VL1, VL2, VL3, VH1, VH2, and/or VH3 specifi-
cally binds to an HIV protein. In some aspects, the poly-
peptide has a structure represented by VL1-VH2-VL3-VH3-
VL2-VH1-CH3-CH3, wherein VL1, VL2, VL3, VH1, VH2,
and/or VH3 specifically binds to an HIV protein. In some
aspects, the polypeptide has a structure represented by
VH1-VL2-VH3-VL3-VH2-VL1-CH3-CH3, wherein VL1,
VL2, VL3, VH1, VH2, and/or VH3 specifically binds to an
HIV protein. In some aspects, the polypeptide has a structure
represented by VL1-VL2-VH3-VL3-VH2-VH1-CH3-CH3,
wherein VL1, VL2, VL3, VH1, VH2, and/or VH3 specifi-
cally binds to an HIV protein. In some aspects, the poly-
peptide has a structure represented by VH1-VH2-VL3-VH3-
VL2-VL1-CH3-CH3, wherein VL1, VL2, VL3, VH1, VH2,
and/or VH3 specifically binds to an HIV protein. In some
aspects, the polypeptide has a structure represented by
VL1-VH2-VH3-VL3-VL2-VH1-CH3-CH3, wherein VL1,
VL2, VL3, VH1, VH2, and/or VH3 specifically binds to an
HIV protein. In some aspects, the polypeptide has a structure
represented by VH1-VL2-VL3-VH3-VH2-VL1-CH3-CH3,
wherein VL1, VL2, VL3, VH1, VH2, and/or VH3 specifi-
cally binds to an HIV protein. In some aspects, the poly-
peptide has a structure represented by VL1-L1-VL2-L2-
VL3-L3-VH3-L4-VH2-L5-VH1-CH3-CH3, wherein VL1,
VL2, VL3, VH1, VH2, and/or VH3 specifically binds to an
HIV protein. In some aspects, the polypeptide has a structure
represented by VH1-L1-VH2-L2-VH3-L3-VL3-L4-VL2-
L5-VL1-CH3-CH3, wherein VL1, VL2, VL3, VH1, VH2,
and/or VH3 specifically binds to an HIV protein. In some
aspects, the polypeptide has a structure represented by VL1-L1-VH2-L2-VL3-L3-VH3-L4-VL2-L5-VH1-CH3-CH3, wherein VL1, VL2, VL3, VH1, VH2, and/or VH3 specifically binds to an HIV protein. In some aspects, the polypeptide has a structure represented by VH1-L1-VL2-L2-VH3-L3-VL3-L4-VH2-L5-VL1-CH3-CH3, wherein VL1, VL2, VL3, VH1, VH2, and/or VH3 specifically binds to an HIV protein. In some aspects, the polypeptide has a structure represented by VL1-L1-VL2-L2-VH3-L3-VL3-L4-VH2-L5-VH1-CH3-CH3, wherein VL1, VL2, VL3, VH1, VH2, and/or VH3 specifically binds to an HIV protein. In some aspects, the polypeptide has a structure represented by VH1-L1-VH2-L2-VL3-L3-VH3-L4-VL2-L5-VL1-CH3-CH3, wherein VL1, VL2, VL3, VH1, VH2, and/or VH3 specifically binds to an HIV protein. In some aspects, the polypeptide has a structure represented by VL1-L1-VH2-L2-VH3-L3-VL3-L4-VL2-L5-VH1-CH3-CH3, wherein VL1, VL2, VL3, VH1, VH2, and/or VH3 specifically binds to an HIV protein. In some aspects, the polypeptide has a structure represented by VH1-L1-VL2-L2-VL3-L3-VH3-L4-VH2-L5-VL1-CH3-CH3, wherein VL1, VL2, VL3, VH1, VH2, and/or VH3 specifically binds to an HIV protein. In some aspects, the polypeptide has a structure represented by VL1-L1-VL2-L2-VL3-L3-VH3-L4-VH2-L5-VH1-L6-CH3-CH3, wherein VL1, VL2, VL3, VH1, VH2, and/or VH3 specifically binds to an HIV protein. In some aspects, the polypeptide has a structure represented by VH1-L1-VH2-L2-VH3-L3-VL3-L4-VL2-L5-VL1-L6-CH3-CH3, wherein VL1, VL2, VL3, VH1, VH2, and/or VH3 specifically binds to an HIV protein. In some aspects, the polypeptide has a structure represented by VL1-L1-VH2-L2-VL3-L3-VH3-L4-VL2-L5-VH1-L6-CH3-CH3, wherein VL1, VL2, VL3, VH1, VH2, and/or VH3 specifically binds to an HIV protein. In some aspects, the polypeptide has a structure represented by VH1-L1-VL2-L2-VH3-L3-VL3-L4-VH2-L5-VL1-L6-CH3-CH3, wherein VL1, VL2, VL3, VH1, VH2, and/or VH3 specifically binds to an HIV protein. In some aspects, the polypeptide has a structure represented by VL1-L1-VL2-L2-VH3-L3-VL3-L4-VH2-L5-VH1-L6-CH3-CH3, wherein VL1, VL2, VL3, VH1, VH2, and/or VH3 specifically binds to an HIV protein. In some aspects, the polypeptide has a structure represented by VH1-L1-VH2-L2-VL3-L3-VH3-L4-VL2-L5-VL1-L6-CH3-CH3, wherein VL1, VL2, VL3, VH1, VH2, and/or VH3 specifically binds to an HIV protein. In some aspects, the polypeptide has a structure represented by VL1-L1-VH2-L2-VH3-L3-VL3-L4-VL2-L5-VH1-L6-CH3-CH3, wherein VL1, VL2, VL3, VH1, VH2, and/or VH3 specifically binds to an HIV protein. In some aspects, the polypeptide has a structure represented by VH1-L1-VL2-L2-VL3-L3-VH3-L4-VH2-L5-VL1-L6-CH3-L7-CH3, wherein VL1, VL2, VL3, VH1, VH2, and/or VH3 specifically binds to an HIV protein. In some aspects, the polypeptide has a structure represented by VL1-L1-VH2-L2-VL3-L3-VH3-L4-VL2-L5-VH1-L6-CH3-L7-CH3, wherein VL1, VL2, VL3, VH1, VH2, and/or VH3 specifically binds to an HIV protein. In some aspects, the polypeptide has a structure represented by VL1-L1-VL2-L2-VH3-L3-VL3-L4-VH2-L5-VH1-L6-CH3-L7-CH3, wherein VL1, VL2, VL3, VH1, VH2, and/or VH3 specifically binds to an HIV protein. In some aspects, the polypeptide has a structure represented by VH1-L1-VH2-L2-VL3-L3-VH3-L4-VL2-L5-VL1-L6-CH3-L7-CH3, wherein VL1, VL2, VL3, VH1, VH2, and/or VH3 specifically binds to an HIV protein. In some aspects, the polypeptide has a structure represented by VL1-L1-VH2-L2-VH3-L3-VL3-L4-VL2-L5-VH1-L6-CH3-L7-CH3, wherein VL1, VL2, VL3, VH1, VH2, and/or VH3 specifically binds to an HIV protein. In some aspects, the polypeptide has a structure represented by VH1-L1-VL2-L2-VL3-L3-VH3-L4-VH2-L5-VL1-L6-CH3-L7-CH3, wherein VL1, VL2, VL3, VH1, VH2, and/or VH3 specifically binds to an HIV protein. The HIV protein is as described herein. For the avoidance of doubt, all the antigen binding polypeptide structures described herein can be combined with any one or more of the HIV targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VH1, VH2, and/or VH3 of each and every antigen binding polypeptide and antigen binding polypeptide complex described herein may independently bind to any one of said particularly preferred targets.

In some aspects, an antigen binding polypeptide complex of the invention comprises first polypeptide, a second polypeptide, and a third polypeptide; wherein the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; or VH1-L1-VL2-L2-VL3-L3-VH3-L4-VH2-L5-VL1; wherein the second polypeptide has a structure represented by VL4-VL5; VL4-L6-VL5; VL4-VL5-VL6; or VL4-L6-VL5-L7-VL6; wherein the third polypeptide has a structure represented by VH4-VH5; VH4-L6-VH5; VH4-VH5-VH6; or VH4-L6-VH5-L7-VH6; wherein VL1 is a first immunoglobulin light chain variable region that specifically binds to an HIV protein; VL2 is a second immunoglobulin light chain variable region that specifically binds to an HIV protein; VL3 is a third immunoglobulin light chain variable region that specifically binds to an HIV protein; VL4 is a fourth immunoglobulin light chain variable region that specifically binds to an HIV protein; VL5 is a fifth immunoglobulin light chain variable region that specifically binds to an HIV protein; VL6 is a sixth immunoglobulin light chain variable region that specifically binds to an HIV protein; VH1 is a first immunoglobulin heavy chain variable region that specifically binds to an HIV protein; VH2 is a second immunoglobulin heavy chain variable region that specifically binds to an HIV protein; VH3 is a third immunoglobulin heavy chain variable region that specifically binds to an HIV protein; VH4 is a fourth immunoglobulin heavy chain variable region that specifically binds to an HIV protein; VH5 is a fifth immunoglobulin heavy chain variable region that specifically binds to an HIV protein; VH6 is a sixth immunoglobulin heavy chain variable region that specifically binds to an HIV protein; and L1, L2, L3, L4, L5, L6 and L7 are amino acid linkers. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-VL5; and the third polypeptide may have the structure represented by VH4-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-VL5; and the third polypeptide may have the structure represented by VH4-L6-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-VL5; and the third polypeptide may have the structure represented by VH4-VH5-VH6. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-VL5; and the third polypeptide may have the structure represented by VH4-L6-VH5-L7-VH6. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-L6-VL5; and the third polypeptide may have the structure represented by VH4-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-L6-VL5; and the third polypeptide may have the structure represented by VH4-L6-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-L6-VL5; and the third polypeptide may have the structure represented by VH4-VH5-VH6. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; or VH1-L1-VL2-L2-VL3-L3-VH3-L4-VH2-L5-VL1; the second polypeptide may have the structure represented by VL4-L6-VL5; and the third polypeptide may have the structure represented by VH4-L6-VH5-L7-VH6. In some aspects, the first polypeptide may have a structure represented by VL1-VL2-VL3-VH3-VH2-VH1; VH1-VH2-

VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-VL5-VL6; and the third polypeptide may have the structure represented by VH4-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-VL5-VL6; and the third polypeptide may have the structure represented by VH4-L6-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; or VH1-L1-VL2-L2-VL3-L3-VH3-L4-VH2-L5-VL1; the second polypeptide may have the structure represented by VL4-VL5-VL6; and the third polypeptide may have the structure represented by VH4-VH5-VH6. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; or VH1-L1-VL2-L2-VL3-L3-VH3-L4-VH2-L5-VL1; the second polypeptide may have the structure represented by VL4-VL5-VL6; and the third polypeptide may have the structure represented by VH4-L6-VH5-L7-VH6. In some aspects, the first polypeptide may have a structure represented by VL1-VL2-VL3-VH3-VH2-VH1; VH1-VH2-VH3-VL3-VH2-VH1; VL1-VH2-VL3-VH3-VL2-VH1; VH1-VL2-VH3-VL3-VH2-VL1; VL1-VL2-VH3-VL3-VH2-VH1; VH1-VH2-VL3-

VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; the second polypeptide may have the structure represented by VL4-L6-VL5-L7-VL6; and the third polypeptide may have the structure represented by VH4-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; or VH1-L1-VL2-L2-VL3-L3-VH3-L4-VH2-L5-VL1; the second polypeptide may have the structure represented by VL4-L6-VL5-L7-VL6; and the third polypeptide may have the structure represented by VH4-L6-VH5. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; or VH1-L1-VL2-L2-VL3-L3-VH3-L4-VH2-L5-VL1; the second polypeptide may have the structure represented by VL4-L6-VL5-L7-VL6; and the third polypeptide may have the structure represented by VH4-VH5-VH6. In some aspects, the first polypeptide may have a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; or VH1-L1-VL2-L2-VL3-L3-VH3-L4-VH2-L5-VL1; the second polypeptide may have the structure represented by VL4-L6-VL5-L7-VL6; and the third polypeptide may have the structure represented by VH4-L6-VH5-L7-VH6. The VL1, VL2, VL3, VL4, VL5, VL6, VH1, VH2, VH3, VH4, VH5, and/or VH6 may specifically bind to a HIV protein as described herein. For the avoidance of doubt, all the antigen binding polypeptide structures described herein can be combined with any one or more of the HIV targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VH1, VH2, and/or VH3 of each and every antigen binding polypeptide and antigen binding polypeptide complex described herein may independently bind to any one of said particularly preferred targets.

In some aspects, an antigen binding polypeptide complex of the invention comprises a first polypeptide, a second polypeptide, and a third polypeptide; wherein the first polypeptide has a structure represented by VL1-VL2-VL3-VH3-VH2-VH1-Fc; VH1-VH2-VH3-VL3-VL2-VL1-Fc; VL1-VH2-VL3-VH3-VL2-VH1-Fc; VH1-VL2-VH3-VL3-VH2-VL1-Fc; VL1-VL2-VH3-VL3-VH2-VH1-Fc; VH1-VH2-VL3-VH3-VL2-VL1-Fc; VL1-VH2-VH3-VL3-VL2-VH1-Fc; VH1-VL2-VL3-VH3-VH2-VL1-Fc; VL1-L1-VL2-L2-VL3-L3-VH3-L4-VH2-L5-VH1-Fc;    VL1-L1-VL2-L2-VL3-L3-VH3-L4-VH2-L5-VH1-L6-Fc; VH1-L1-VH2-L2-VH3-L3-VL3-L4-VL2-L5-VL1-Fc;    VH1-L1-VH2-L2-VH3-L3-VL3-L4-VL2-L5-VL1-L6-Fc; VL1-L1-VH2-L2-VL3-L3-VH3-L4-VL2-L5-VH1-Fc;    VL1-L1-VL2-L2-VL3-L3-VH3-L4-VL2-L5-VH1-L6-Fc; VH1-L1-VL2-L2-VH3-L3-VL3-L4-VH2-L5-VL1-Fc;    VH1-L1-VL2-L2-VH3-L3-VL3-L4-VH2-L5-VL1-L6-Fc; VL1-L1-VL2-L2-VH3-L3-VL3-L4-VH2-L5-VH1-Fc;    VL1-L1-VL2-L2-VH3-L3-VL3-L4-VH2-L5-VH1-L6-Fc; VH1-L1-VH2-L2-VL3-L3-VH3-L4-VL2-L5-VL1-Fc;    VH1-L1-VH2-L2-VL3-L3-VH3-L4-VL2-L5-VL1-L6-Fc; VL1-L1-VH2-L2-VH3-L3-VL3-L4-VL2-L5-VH1-Fc;    VL1-L1-VH2-L2-VH3-L3-VL3-L4-VL2-L5-VH1-L6-Fc; VH1-L1-VL2-L2-VL3-L3-VH3-L4-VH2-L5-VL1-Fc; or VH1-L1-VL2-L2-VL3-L3-VH3-L4-VH2-L5-VL1-L6-Fc; wherein the second polypeptide has a structure represented by VL4-VL5; VL4-L7-VL5; VL4-CL; VL4-L7-CL; VL4-CH1; VL4-L7-CH1; VH4-VH5; VH4-L7-VH5; VH4-CL; VH4-L7-CL; VH4-CH1; VH4-L7-CH1; VL4-VL5-VL6; VL4-L7-VL5-L8-VL6; VL4-VL5-VL6-CL; VL4-L7-VL5-L8-VL6-CL; VL4-L7-VL5-L8-VL6-L9-CL; VL4-VL5-VL6-CH1; VL4-L7-VL5-L8-VL6-CH1; VL4-L7-VL5-L8-VL6-L9-CH1; VH4-VH5-VH6; VH4-L7-VH5-L8-VH6; VH4-VH5-VH6-CL; VH4-L7-VH5-L8-VH6-CL;    VH4-L7-VH5-L8-VH6-L9-CL; VH4-VH5-VH6-CH1; VH4-L7-VH5-L8-VH6-CH1; or VH4-L7-VH5-L8-VH6-L9-CH1; wherein the third polypeptide has a structure represented by VH4-VH5-Fc; VH4-L10-VH5-Fc; VH4-L10-VH5-L11-Fc; VH4-CH1-F c; VH4-L10-CH1-Fc; VH4-L10-CH1-L11-Fc; VH4-CL-Fc; VH4-L10-CL-Fc; VH4-L10-CL-L11-Fc; VH4-VH5-Fc; VH4-L10-VH5-Fc; VH4-L10-VH5-L11-Fc; VH4-VH5-VH6-Fc; VH4-L10-VH5-L11-VH6-Fc;    VH4-L10-VH5-L11-VH6-L12-Fc; VH4-VH5-VH6-CH1-Fc; VH4-L10-VH5-L11-VH6-CH1-Fc;    VH4-L10-VH5-L11-VH6-L12-CH1-Fc; VH4-L10-VH5-L11-VH6-L12-CH1-L13-Fc; VH4-VH5-VH6-CL-Fc; VH4-L10-VH5-L11-VH6-CL-Fc; VH4-L10-VH5-L11-VH6-L12-CL-Fc;    VH4-L10-VH5-L11-VH6-L12-CL-L13-Fc; VL4-VL5-VL6-Fc; VL4-L10-VL5-L11-VL6-Fc; VL4-L10-VL5-L11-VL6-L12-Fc; VL4-VL5-VL6-CH1-Fc; VL4-L10-VL5-L11-VL6-CH1-Fc VL4-L10-VL5-L11-VL6-L12-CH1-Fc;    VL4-L10-VL5-L11-VL6-L12-CH1-L13-Fc; VL4-VL5-VL6-CL-Fc; VL4-L10-VL5-L11-VL6-CL-Fc; VL4-L10-VL5-L11-VL6-L12-CL-Fc; or VL4-L10-VL5-L11-VL6-L12-CL-L13-Fc; wherein VL1 is a first immunoglobulin light chain variable region that specifically binds to an HIV protein; VL2 is a second immunoglobulin light chain variable region that specifically binds to an HIV protein; VL3 is a third immunoglobulin light chain variable region that specifically binds to an HIV protein; VL4 is a fourth immunoglobulin light chain variable region that specifically binds to an HIV protein; VL5 is a fifth immunoglobulin light chain variable region that specifically binds to an HIV protein; VL6 is a sixth immunoglobulin light chain variable region that specifically binds to an HIV protein; VH1 is a first immunoglobulin heavy chain variable region that specifically binds to an HIV protein; VH2 is a second immunoglobulin heavy chain variable region that specifically binds to an HIV protein; VH3 is a third immunoglobulin heavy chain variable region that specifically binds to an HIV protein; VH4 is a fourth immunoglobulin heavy chain variable region that specifically binds to an HIV protein; VH5 is a fifth immunoglobulin heavy chain variable region that specifically binds to an HIV protein; VH6 is a sixth immunoglobulin heavy chain variable region that specifically binds to an HIV protein; CH1 is a heavy chain constant region 1; CL is a light chain constant region; Fc is a region comprising an immunoglobulin heavy chain constant region 2 (CH2), an immunoglobulin heavy chain constant region 3 (CH3), and optionally, an immunoglobulin hinge; and L1, L2, L3, L4, L5, L6, L7, L8, L9, L10, L11, L12 and L13 are amino acid linkers. For the avoidance of doubt, all the antigen binding polypeptide structures described herein can be combined with any one or more of the HIV targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VL4, VL5, VL6, VH1, VH2, VH3, VH4, VH5 and/or VH6 of each and every antigen binding polypeptide and antigen binding polypeptide complex described herein may independently bind to any one of said particularly preferred targets.

In some aspects, one or more of VH1, VH2, VH3, VH4, VH5 and VH6 of the antigen binding polypeptide or antigen binding polypeptide complex can specifically bind to the same antigen or different antigens. In some aspects, one or more of VL1, VL2, VL3, VL4, VL5 and VL6 of the antigen binding polypeptide or antigen binding polypeptide complex can specifically bind to the same antigen or different antigens.

In some aspects, VH1, VL1, VH4 and VL4 of the antigen binding polypeptide or antigen binding polypeptide complex specifically bind to the same antigen. In some aspects, VH2, VL2, VH5 and VL5 of the antigen binding polypeptide or antigen binding polypeptide complex specifically bind to the same antigen. In some aspects, VH3, VL3, VH6 and VL6 of the antigen binding polypeptide or antigen binding polypeptide complex specifically bind to the same antigen. In some aspects, VH1, VL1, VH4 and VL4 of the antigen binding polypeptide or antigen binding polypeptide complex specifically bind to the same antigen; VH2, VL2, VH5 and VL5 of the antigen binding polypeptide or antigen binding polypeptide complex specifically bind to the same antigen; and VH3, VL3, VH6 and VL6 of the antigen binding polypeptide or antigen binding polypeptide complex specifically bind to the same antigen.

In some aspects of the antigen binding polypeptide or antigen binding polypeptide complex, VH1, VH2 and VH3 each comprise a heavy chain variable region from the PGT121, VRC01, 10E8v4 or PG16 antibody or a variant thereof; and/or VL1, VL2 and VL3 each comprise a light chain variable region from the PGT121, VRC01, 10E8v4 or PG16 antibody or a variant thereof.

In some aspects of the antigen binding polypeptide or antigen binding polypeptide complex, VH1, VH2, VH3 and VH4 each comprise a heavy chain variable region from the PGT121, VRC01, 10E8v4 or PG16 antibody or a variant thereof; and/or VL1, VL2, VL3 and VL4 each comprise a light chain variable region from the PGT121, VRC01, 10E8v4 or PG16 antibody or a variant thereof.

In some aspects of the antigen binding polypeptide or antigen binding polypeptide complex, VH1, VH2, VH3, VH4 and VH5 each comprise a heavy chain variable region from the PGT121, VRC01, 10E8v4 or PG16 antibody or a variant thereof; and/or VL1, VL2, VL3, VL4 and VL5 each comprise a light chain variable region from the PGT121, VRC01, 10E8v4 or PG16 antibody or a variant thereof.

In some aspects of the antigen binding polypeptide or antigen binding polypeptide complex, VH1, VH2, VH3, VH4, VH5 and VH6 each comprise a heavy chain variable region from the PGT121, VRC01, 10E8v4 or PG16 antibody or a variant thereof; and/or VL1, VL2, VL3, VL4, VL5 and VL6 each comprise a light chain variable region from the PGT121, VRC01, 10E8v4 or PG16 antibody or a variant thereof.

In some aspects, antigen binding polypeptides or antigen binding polypeptide complexes comprise VH and VL sequences from broadly neutralizing antibodies that target CD4bs inclusive of VRC01, VRC03, 3BNC117, N6, N49P7, 3BNC60, VRC-PG04, VRC-PG20, NIH45-46, VRC-CH31, 12A12, CH103, 8ANC131, VRC13 and VRC16.

In some aspects, VH1, VH2 and VH3 of the antigen binding polypeptide or antigen binding polypeptide complex each comprise an amino acid sequence having at least 90% identity, at least 95% identity or 100% identity to any one of SEQ ID NOs:349-352; and/or VL1, VL2 and VL3 each comprise an amino acid sequence having at least 90% identity, at least 95% identity or 100% identity to any one of SEQ ID NOs:353-356. For example, VH1, VH2 and VH3 may each comprise an amino acid sequence having at least 90% identity to any one of SEQ ID NOs:349-352. For example, VL1, VL2 and VL3 may each comprise an amino acid sequence having at least 90% identity to any one of SEQ ID NOs:353-356. At least 90% identity may include at least 91%, 92%, 93%, 94%, 95%, 96%, 97%, 98%, 99% or 100% identity to the reference polypeptide sequence. For example, the VH1, VH2 and VH3 may each comprise the amino acid sequence of any one of SEQ ID Nos:349-352. For example, VL1, VL2 and VL3 may each comprise the amino acid sequence of any one of SEQ ID Nos:353-356.

In some aspects, VH1, VH2, VH3 and VH4 of the antigen binding polypeptide or antigen binding polypeptide complex each comprise an amino acid sequence having at least 90% identity, at least 95% identity or 100% identity to any one of SEQ ID Nos:349-352; and/or VL1, VL2, VL3 and VL4 each comprise an amino acid sequence having at least 90% identity, at least 95% identity or 100% identity to any one of SEQ ID Nos:353-356. For example, the VH1, VH2, VH3 and VH4 may each comprise an amino acid sequence having at least 90% identity to any one of SEQ ID Nos:349-352. For example, the VL1, VL2, VL3 and VL4 may each comprise an amino acid sequence having at least 90% identity to any one of SEQ ID Nos:353-356. At least 90% identity may include at least 91%, 92%, 93%, 94%, 95%, 96%, 97%, 98%, 99% or 100% identity to the reference polypeptide sequence. For example, the VH1, VH2, VH3 and VH4 may each comprise the amino acid sequence of any one of SEQ ID Nos:349-352. For example, the VL1, VL2, VL3 and VL4 may each comprise the amino acid sequence of any one of SEQ ID Nos:353-356.

In some aspects, VH1, VH2, VH3, VH4 and VH5 of an antigen binding polypeptide or antigen binding polypeptide complex of the invention each comprise an amino acid sequence having at least 90% identity, at least 95% identity or 100% identity to any one of SEQ ID NOs:349-352; and/or VL1, VL2, VL3, VL4 and VL5 each comprise an amino acid sequence having at least 90% identity, at least 95% identity or 100% identity to any one of SEQ ID NOs:353-356. For example, the VH1, VH2, VH3, VH4 and VH5 may each comprise an amino acid sequence having at least 90% identity to any one of SEQ ID Nos:349-352. For example, the VL1, VL2, VL3, VL4 and VL5 may each comprise an amino acid sequence having at least 90% identity to any one of SEQ ID NOs:353-356. At least 90% identity may include at least 91%, 92%, 93%, 94%, 95%, 96%, 97%, 98%, 99% or 100% identity to the reference polypeptide sequence. For example, the VH1, VH2, VH3, VH4 and VH5 may each comprise the amino acid sequence of any one of SEQ ID Nos:349-352. For example, the VL1, VL2, VL3, VL4 and VL5 may each comprise the amino acid sequence having of any one of SEQ ID NOs:353-356.

In some aspects, VH1, VH2, VH3, VH4, VH5 and VH6 of an antigen binding polypeptide or antigen binding polypeptide complex of the invention each comprise an amino acid sequence having at least 90% identity, at least 95% identity or 100% identity to any one of SEQ ID NOs:349-352; and/or VL1, VL2, VL3, VL4, VL5 and VL6 each comprise an amino acid sequence having at least 90% identity, at least 95% identity or 100% identity to any one of SEQ ID NOs:353-356. For example, the VH1, VH2, VH3, VH4, VH5 and VH6 may each comprise an amino acid sequence having at least 90% identity to any one of SEQ ID NOs:349-352. For example, the VL1, VL2, VL3, VL4, VL5 and VL6 may each comprise an amino acid sequence having at least 90% identity to any one of SEQ ID NOs:353-356. At least 90% identity may include at least 91%, 92%, 93%, 94%, 95%, 96%, 97%, 98%, 99% or 100% identity to the reference polypeptide sequence. For example, the VH1, VH2, VH3, VH4, VH5 and VH6 may each comprise the amino acid sequence of any one of SEQ ID NOs:349-352. For example, the VL1, VL2, VL3, VL4, VL5 and VL6 may each comprise the amino acid sequence of any one of SEQ ID NOs:353-356.

In some aspects, VH1, VH2 and VH3 of an antigen binding polypeptide or antigen binding polypeptide complex of the invention each comprise a CDR1 having an amino acid sequence with at least 90% identity, at least 95% identity or 100% identity to any one of SEQ ID NOs:357, 360, 363 and 366; a CDR2 having an amino acid sequence with at least 90% identity, at least 95% identity or 100% identity to any one of SEQ ID NOs:358, 361, 364 and 367; and a CDR3 having an amino acid sequence with at least 90% identity, at least 95% identity or 100% identity to any one of SEQ ID NOs:359, 362, 365 and 368; and VL1, VL2 and VL3 each comprise a CDR1 having an amino acid sequence with at least 90% identity, at least 95% identity or 100% identity to any one of SEQ ID NOs:369, 372, 375 and 378; a CDR2 having an amino acid sequence with at least 90% identity, at least 95% identity or 100% identity to any one of SEQ ID NOs:370, 373, 376 and 379; and a CDR3 having an amino acid sequence with at least 90% identity, at least 95% identity or 100% identity to any one of SEQ ID NOs:371, 374, 377 and 380. For example, the VH1, VH2 and VH3 may each comprise a CDR1 having an amino acid sequence with at least 90% identity to any one of SEQ ID NOs:357, 360, 363 and 366; a CDR2 having an amino acid sequence with at least 90% identity to any one of SEQ ID NOs:358, 361, 364 and 367; and a CDR3 having an amino acid sequence with at least 90% identity to any one of SEQ ID NOs:359, 362, 365 and 368. For example, the VL1, VL2 and VL3 may each comprise a CDR1 having an amino acid sequence with at least 90% identity to any one of SEQ ID NOs:369, 372, 375 and 378; a CDR2 having an amino acid sequence with at least 90% identity to any one of SEQ ID NOs:370, 373, 376 and 379; and a CDR3 having an amino acid sequence with at least 90% identity to any one of SEQ ID NOs:371, 374, 377 and 380. At least 90% identity may include at least 91%, 92%, 93%, 94%, 95%, 96%, 97%, 98%, 99% or 100% identity to the reference polypeptide sequence. For example, the VH1, VH2 and VH3 may each comprise a CDR1 having the amino acid sequence of any one of SEQ ID NOs:357, 360, 363 and 366; a CDR2 having the amino acid sequence of any one of SEQ ID NOs:358, 361, 364 and 367; and a CDR3 having the amino acid sequence of any one of SEQ ID NOs:359, 362, 365 and 368. For example, the VL1, VL2 and VL3 may each comprise a CDR1 having the amino acid sequence of any one of SEQ ID NOs:369, 372, 375 and 378; a CDR2 having the amino acid sequence of any one of SEQ ID NOs:370, 373, 376 and 379; and a CDR3 having the amino acid sequence of any one of SEQ ID NOs:371, 374, 377 and 380.

In some aspects, VH1, VH2, VH3 and VH4 of an antigen binding polypeptide or antigen binding polypeptide complex of the invention each comprise a CDR1 having an amino acid sequence with at least 90% identity, at least 95% identity or 100% identity to any one of SEQ ID NOs:357, 360, 363 and 366; a CDR2 having an amino acid sequence with at least 90% identity, at least 95% identity or 100% identity to any one of SEQ ID NOs:358, 361, 364 and 367; and a CDR3 having an amino acid sequence with at least 90% identity, at least 95% identity or 100% identity to any one of SEQ ID NOs:359, 362, 365 and 368; and VL1, VL2, VL3 and VL4 each comprise a CDR1 having an amino acid sequence with at least 90% identity, at least 95% identity or 100% identity to any one of SEQ ID NOs:369, 372, 375 and 378; a CDR2 having an amino acid sequence with at least 90% identity, at least 95% identity or 100% identity to any one of SEQ ID NOs:370, 373, 376 and 379; and a CDR3 having an amino acid sequence with at least 90% identity, at least 95% identity or 100% identity to any one of SEQ ID NOs:371, 374, 377 and 380. For example, the VH1, VH2, VH3 and VH4 may each comprise a CDR1 having an amino acid sequence with at least 90% identity to any one of SEQ ID NOs:357, 360, 363 and 366; a CDR2 having an amino acid sequence with at least 90% identity to any one of SEQ ID NOs:358, 361, 364 and 367; and a CDR3 having an amino acid sequence with at least 90% identity to any one of SEQ ID NOs:359, 362, 365 and 368. For example, the VL1, VL2, VL3 and VL4 may each comprise a CDR1 having an amino acid sequence with at least 90% identity to any one of SEQ ID NOs:369, 372, 375 and 378; a CDR2 having an amino acid sequence with at least 90% identity to any one of SEQ ID NOs:370, 373, 376 and 379; and a CDR3 having an amino acid sequence with at least 90% identity to any one of SEQ ID NOs:371, 374, 377 and 380. At least 90% identity may include at least 91%, 92%, 93%, 94%, 95%, 96%, 97%, 98%, 99% or 100% identity to the reference polypeptide sequence. For example, the VH1, VH2, VH3 and VH4 may each comprise a CDR1 having the amino acid sequence of any one of SEQ ID NOs:357, 360, 363 and 366; a CDR2 having the amino acid sequence of any one of SEQ ID NOs:358, 361, 364 and 367; and a CDR3 having the amino acid sequence of any one of SEQ ID NOs:359, 362, 365 and 368. For example, the VL1, VL2, VL3 and VL4 may each comprise a CDR1 having the amino acid sequence of any one of SEQ ID NOs:369, 372, 375 and 378; a CDR2 having the amino acid sequence of any one of SEQ ID NOs:370, 373, 376 and 379; and a CDR3 having the amino acid sequence of any one of SEQ ID NOs:371, 374, 377 and 380.

In some aspects, VH1, VH2, VH3, VH4 and VH5 of an antigen binding polypeptide or antigen binding polypeptide complex of the invention each comprise a CDR1 having an amino acid sequence with at least 90% identity, at least 95% identity or 100% identity to any one of SEQ ID NOs:357, 360, 363 and 366; a CDR2 having an amino acid sequence with at least 90% identity, at least 95% identity or 100% identity to any one of SEQ ID NOs:358, 361, 364 and 367; and a CDR3 having an amino acid sequence with at least 90% identity, at least 95% identity or 100% identity to any one of SEQ ID NOs:359, 362, 365 and 368; and VL1, VL2, VL3, VL4 and VL5 each comprise a CDR1 having an amino acid sequence with at least 90% identity, at least 95% identity or 100% identity to any one of SEQ ID NOs:369, 372, 375 and 378; a CDR2 having an amino acid sequence with at least 90% identity, at least 95% identity or 100% identity to any one of SEQ ID NOs:370, 373, 376 and 379; and a CDR3 having an amino acid sequence with at least 90% identity, at least 95% identity or 100% identity to any one of SEQ ID NOs:371, 374, 377 and 380. For example, the VH1, VH2, VH3, VH4 and VH5 may each comprise a CDR1 having an amino acid sequence with at least 90% identity to any one of SEQ ID NOs:357, 360, 363 and 366; a CDR2 having an amino acid sequence with at least 90% identity to any one of SEQ ID NOs:358, 361, 364 and 367; and a CDR3 having an amino acid sequence with at least 90% identity to any one of SEQ ID NOs:359, 362, 365 and 368. For example, the VL1, VL2, VL3, VL4 and VL5 may each comprise a CDR1 having an amino acid sequence with at least 90% identity to any one of SEQ ID NOs:369, 372, 375 and 378; a CDR2 having an amino acid sequence with at least 90% identity to any one of SEQ ID NOs:370, 373, 376 and 379; and a CDR3 having an amino acid sequence with at least 90% identity to any one of SEQ ID NOs:371, 374, 377 and 380. At least 90% identity may include at least 91%, 92%, 93%, 94%, 95%, 96%, 97%, 98%, 99% or 100% identity to the reference polypeptide sequence. For example, the VH1, VH2, VH3, VH4 and VH5 may each comprise a CDR1 having the amino acid sequence of any one of SEQ ID NOs:357, 360, 363 and 366; a CDR2 having the amino acid sequence with of any one of SEQ ID NOs:358, 361, 364 and 367; and a CDR3 having the amino acid sequence of any one of SEQ ID NOs:359, 362, 365 and 368. For example, the VL1, VL2, VL3, VL4 and VL5 may each comprise a CDR1 having the amino acid sequence of any one of SEQ ID NOs:369, 372, 375 and 378; a CDR2 having the amino acid sequence of any one of SEQ ID NOs:370, 373, 376 and 379; and a CDR3 having the amino acid sequence of any one of SEQ ID NOs:371, 374, 377 and 380.

In some aspects, VH1, VH2, VH3, VH4, VH5 and VH6 of an antigen binding polypeptide or antigen binding polypeptide complex of the invention each comprise a CDR1 having an amino acid sequence with at least 90% identity, at least 95% identity or 100% identity to any one of SEQ ID NOs:357, 360, 363 and 366; a CDR2 having an amino acid sequence with at least 90% identity, at least 95% identity or 100% identity to any one of SEQ ID NOs:358, 361, 364 and 367; and a CDR3 having an amino acid sequence with at least 90% identity, at least 95% identity or 100% identity to any one of SEQ ID NOs:359, 362, 365 and 368; and VL1, VL2, VL3, VL4, VL5 and VL6 each comprise a CDR1 having an amino acid sequence with at least 90% identity, at least 95% identity or 100% identity to any one of SEQ ID NOs:369, 372, 375 and 378; a CDR2 having an amino acid sequence with at least 90% identity, at least 95% identity or 100% identity to any one of SEQ ID NOs:370, 373, 376 and 379; and a CDR3 having an amino acid sequence with at least 90% identity, at least 95% identity or 100% identity to any one of SEQ ID NOs:371, 374, 377 and 380. For example, the VH1, VH2, VH3, VH4, VH5 and VH6 may each comprise a CDR1 having an amino acid sequence with at least 90% identity to any one of SEQ ID NOs:357, 360, 363 and 366; a CDR2 having an amino acid sequence with at least 90% identity to any one of SEQ ID NOs:358, 361, 364 and 367; and a CDR3 having an amino acid sequence with at least 90% identity to any one of SEQ ID NOs:359, 362, 365 and 368. For example, the VL1, VL2, VL3, VL4, VL5 and VL6 may each comprise a CDR1 having an amino acid sequence with at least 90% identity to any one of SEQ ID NOs:369, 372, 375 and 378; a CDR2 having an amino acid sequence with at least 90% identity to any one of SEQ ID NOs:370, 373, 376 and 379; and a CDR3 having an amino acid sequence with at least 90% identity to any one of SEQ ID NOs:371, 374, 377 and 380. At least 90% identity may include at least 91%, 92%, 93%, 94%, 95%, 96%, 97%, 98%, 99% or 100% identity to the reference polypeptide sequence. For example, the VH1, VH2, VH3, VH4, VH5 and VH6 may each comprise a CDR1 having the amino acid sequence of any one of SEQ ID NOs:357, 360, 363 and 366; a CDR2 having the amino acid sequence of any one of SEQ ID NOs:358, 361, 364 and 367; and a CDR3 having the amino acid sequence of any one of SEQ ID NOs:359, 362, 365 and 368. For example, the VL1, VL2, VL3, VL4, VL5 and VL6 may each comprise a CDR1 having the amino acid sequence of any one of SEQ ID NOs:369, 372, 375 and 378; a CDR2 having the amino acid sequence of any one of SEQ ID NOs:370, 373, 376 and 379; and a CDR3 having the amino acid sequence of any one of SEQ ID NOs:371, 374, 377 and 380.

In some aspects, one or more of VH1, VH2, VH3, VH4, VH5 and VH6 of an antigen binding polypeptide or antigen binding polypeptide complex of the invention comprises an amino acid sequence encoded by a polynucleotide having at least 90% identity, at least 95% identity or 100% identity to SEQ ID NO:381 or 382; and/or one or more of VL1, VL2, VL3, VL4, VL5 and VL6 of an antigen binding polypeptide or antigen binding polypeptide complex of the invention comprises an amino acid sequence encoded by a polynucleotide having at least 90% identity, at least 95% identity or 100% identity to SEQ ID NO:383 or 384. For example, one or more of VH1, VH2, VH3, VH4, VH5 and VH6 may comprise an amino acid sequence encoded by a polynucleotide having at least 90% identity to SEQ ID NO:381 or 382. For example, one or more of VL1, VL2, VL3, VL4, VL5 and VL6 may comprise an amino acid sequence encoded by a polynucleotide having at least 90% identity to SEQ ID NO:383 or 384. At least 90% identity may include at least 91%, 92%, 93%, 94%, 95%, 96%, 97%, 98%, 99% or 100% identity to the reference polynucleotide sequence. For example, one or more of VH1, VH2, VH3, VH4, VH5 and VH6 may comprise an amino acid sequence encoded by the polynucleotide of SEQ ID NO:381 or 382. For example, one or more of VL1, VL2, VL3, VL4, VL5 and VL6 may comprise an amino acid sequence encoded by the polynucleotide of SEQ ID NO:383 or 384.

In some aspects, the heavy chain CDR1 may comprise an amino acid sequence having at least 90% identity to any one of SEQ ID NOs:357, 360, 363 and 366; the heavy chain CDR2 may comprise an amino acid sequence having at least 90% identity to any one of SEQ ID NOs:358, 361, 364 and 367; the heavy chain CDR3 may comprise an amino acid sequence having at least 90% identity to any one of SEQ ID NOs:359, 362, 365 and 368; the light chain CDR1 may comprise an amino acid sequence having at least 90% identity to any one of SEQ ID NOs:369, 372, 375 and 378; the light chain CDR2 may comprise an amino acid sequence having at least 90% identity to any one of SEQ ID NOs:370, 373, 376 and 379; and the light chain CDR3 may comprise an amino acid sequence having at least 90% identity to any one of SEQ ID NOs:371, 374, 377 and 380. For example, the heavy chain CDR1 may comprise an amino acid sequence of SEQ ID NO:357; the heavy chain CDR2 may comprise an amino acid sequence of SEQ ID NO:358; the heavy chain CDR3 may comprise an amino acid of SEQ ID NO:359; the light chain CDR1 may comprise an amino acid sequence of SEQ ID NO:372; the light chain CDR2 may comprise an amino acid sequence of SEQ ID NO:373; the light chain CDR3 may comprise an amino acid sequence of SEQ ID NO:374. For example, the heavy chain CDR1 may comprise an amino acid sequence of SEQ ID NO:360; the heavy chain CDR2 may comprise an amino acid sequence of SEQ ID NO:361; the heavy chain CDR3 may comprise an amino acid of SEQ ID NO:362; the light chain CDR1 may comprise an amino acid sequence of SEQ ID NO:375; the light chain CDR2 may comprise an amino acid sequence of SEQ ID NO:376; the light chain CDR3 may comprise an amino acid sequence of SEQ ID NO:377. For example, the heavy chain CDR1 may comprise an amino acid sequence of SEQ ID NO:363; the heavy chain CDR2 may comprise an amino acid sequence of SEQ ID NO:364; the heavy chain CDR3 may comprise an amino acid of SEQ ID NO:365; the light chain CDR1 may comprise an amino acid sequence of SEQ ID NO:378; the light chain CDR2 may comprise an amino acid sequence of SEQ ID NO:379; the light chain CDR3 may comprise an amino acid sequence of SEQ ID NO:380. For example, the heavy chain CDR1 may comprise an amino acid sequence of SEQ ID NO:366; the heavy chain CDR2 may comprise an amino acid sequence of SEQ ID NO:367; the heavy chain CDR3 may comprise an amino acid of SEQ ID NO:368; the light chain CDR1 may comprise an amino acid sequence of SEQ ID NO:369; the light chain CDR2 may comprise an amino acid sequence of SEQ ID NO:370; the light chain CDR3 may comprise an amino acid sequence of SEQ ID NO:371.

In some aspects, an antigen binding polypeptide or antigen binding polypeptide complex of the invention comprises one or more amino acid sequences having at least 80%, at least 85%, at least 90%, at least 95%, at least 96%, at least 96%, at least 97%, at least 98%, at least 99% or 100% identity to any one of SEQ ID NOs:385-388. For example, the antigen binding polypeptide or antigen binding polypeptide complex of the invention may comprise an amino acid sequence having at least 80% identity (such as at least 85%, at least 90%, at least 95%, at least 96%, at least 96%, at least 97%, at least 98%, at least 99% or 100% identity) to SEQ ID NO: 385. For example, the antigen binding polypeptide or antigen binding polypeptide complex of the invention may comprise an amino acid sequence having at least 80% identity (such as at least 85%, at least 90%, at least 95%, at least 96%, at least 96%, at least 97%, at least 98%, at least 99% or 100% identity) to SEQ ID NO: 386. For example, the antigen binding polypeptide or antigen binding polypeptide complex of the invention may comprise an amino acid sequence having at least 80% identity (such as at least 85%, at least 90%, at least 95%, at least 96%, at least 96%, at least 97%, at least 98%, at least 99% or 100% identity) to SEQ ID NO: 387. For example, the antigen binding polypeptide or antigen binding polypeptide complex of the invention may comprise an amino acid sequence having at least 80% identity (such as at least 85%, at least 90%, at least 95%, at least 96%, at least 96%, at least 97%, at least 98%, at least 99% or 100% identity) to SEQ ID NO: 388. In some aspects, provided herein is an antigen binding polypeptide having a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VH1-VH2-VL3-VH3-VL2-VL1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1; wherein VL1 is a first immunoglobulin light chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; VL2 is a second immunoglobulin light chain variable region that specifically binds to at least one epitope on at least one antigen selected from the group consisting of Env, gp160, p120, gp41, p17, p24, p7, p55, p66, p31, Nef, Tat, Rev, Vif, Vpr and Vpu; VL3 is a third immunoglobulin light chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; VH1 is a first immunoglobulin heavy chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; VH2 is a second immunoglobulin heavy chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; VH3 is a third immunoglobulin heavy chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; L1, L2, L3, L4 and L5 are amino acid linkers; wherein said antigen binding polypeptide further comprises at least one of the following (i)-(xxi): (i) an Fc region having an optional immunoglobulin hinge, wherein the immunoglobulin hinge comprises an upper hinge region, a middle hinge region, a lower hinge region, or a combination thereof; (ii) a linker selected from the group consisting of L1, L2, L3, L4 and L5 having a length of from about 1 amino acid to about 50 amino acids; (iii) a linker selected from the group consisting of L1, L2, L3, L4 and L5 selected from the group consisting of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 679, SEQ ID NO: 680, SEQ ID NO: 681, SEQ ID NO: 682, SEQ ID NO: 683, SEQ ID NO: 684, SEQ ID NO: 685, and SEQ ID NO: 686, or a sequence having at least 50%, at least 60%, at least 70%, at least 80%, at least 90%, or at least 95% identity to any one of SEQ ID NOs:1-19 and 679-686; (iv) a linker selected from the group consisting of L1, L2, L3, L4 and L5 which is non-immunogenic; (v) a linker selected from the group consisting of L1, L2, L3, L4 and L5 wherein said linker does not contain a consensus T cell epitope; (vi) an Fc region comprising at least one knob-into-hole modification; (vii) a detectable label; (viii) a detectable label selected from the group consisting of a radioactive label, chemiluminescent label, fluorescent label, enzyme, or peptide tag, or a combination thereof; (ix) a peptide tag; (x) a peptide tag selected from a polyhistidine tag consisting of from about 4 to about 10 histidine residues; (xi) a peptide tag having about 8 histidine residues; (xii) the polypeptide is conjugated to an agent to form an antibody-agent conjugate; (xiii) an antibody-agent conjugate wherein the agent is selected from the group consisting of a cytotoxic agent, an immunomodulating agent, an imaging agent, a therapeutic protein, or a combination thereof; (xiv) an antigen binding polypeptide having an equilibrium dissociation constant (KD) of from about 10 μM to about 1 pM when bound to an epitope on a target antigen or when complexed with another antigen binding polypeptide to form an antigen binding polypeptide complex having at least two antigen binding polypeptides; (xv) an antibody or antigen binding fragment thereof; (xvi) an antibody or antigen binding fragment thereof selected from the group consisting of IgG, IgM, IgE, IgA or IgD; (xvii) an antibody or antigen binding fragment thereof selected from an IgG antibody selected from the group consisting of IgG1, IgG2, IgG3 or IgG4; (xviii) an antibody or antigen binding fragment selected from the group consisting of Fab, scFab, Fab', F(ab')₂, Fv or scFv; (xix) an antigen binding polypeptide having an effector function mutation; (xx) an antigen binding polypeptide which, when formed into an antigen binding polypeptide complex, is an IgG1 or IgG4 antibody and the knob-into-hole modification comprises: (i) knob substitutions of S354C and T366W and hole substitutions of Y349C, T366S, L368A and Y407V; (ii) hole substitutions of L234A, L235A and P239A; (iii) hole substitutions of L234A and L235A; (iv) hole substitutions of M428L and N433S; (v) hole substitutions of M252Y, S254T and T256E; or (vi) a combination thereof, based on the EU numbering scheme; and (xxi) an antigen binding polypeptide as part of a chimeric receptor antigen. For the avoidance of doubt, all the antigen binding polypeptide structures described herein can be combined with any one or more of the HIV targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VL4, VL5, VL6, VH1, VH2, VH3, VH4, VH5 and/or VH6 of each and every antigen binding polypeptide and antigen binding polypeptide complex described herein may independently bind to any one of said particularly preferred targets. In other aspects, provided herein is an antigen binding polypeptide complex comprising a first polypeptide and a second polypeptide; wherein the first polypeptide has a structure represented by VL1-VL2-VL3-VH3-VH2-VH1; VH1-VH2-VH3-VL3-VL2-VL1; VL1-VH2-VL3-VH3-VL2-VH1; VH1-VL2-VH3-VL3-VH2-VL1; VL1-VL2-VH3-VL3-VH2-VH1; VL1-VH2-VH3-VL3-VL2-VH1; VH1-VL2-VL3-VH3-VH2-VL1; VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-

VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VH2-L2-VL5-VH1; or VH1-L1-VL2-L2-VL3-L3-VH3-L4-VH2-L5-VL1; wherein the second polypeptide has a structure represented by VL4-VH4; VH4-VL4; VL4-L6-VH4; VH4-L6-VL4; VL4-VL5-VH5-VH4; VH4-VH5-VL5-VL4; VL4-L6-VL5-L7-VH5-L8-VH4; VH4-L6-VH5-L7-VL5-L8-VL4; VL4-VL5-VL6-VH6-VH5-VH4; VH4-VH5-VH6-VL6-VL5-VL4; VL4-VH5-VL6-VH6-VL5-VH4; VH4-VL5-VH6-VL6-VH5-VL4; VL4-VL5-VH6-VL6-VH5-VH4; VH4-VH5-VL6-VH6-VL5-VL4; VL4-VH5-VH6-VL6-VL5-VH4; VH4-VL5-VL6-VH6-VH5-VL4; VL4-L6-VL5-L7-VL6-L8-VH6-L9-VH5-L10-VH4; VH4-L6-VH5-L7-VH6-L8-VL6-L9-VL5-L10-VL4; VL4-L6-VH5-L7-VL6-L8-VH6-L9-VL5-L10-VH4; VH4-L6-VL5-L7-VH6-L8-VL6-L9-VH5-L10-VL4; VL4-L6-VL5-L7-VH6-L8-VL6-L9-VH5-L10-VL4; VH4-L6-VH5-L7-VL6-L8-VH6-L9-VL5-L10-VL4; VL4-L6-VH5-L7-VH6-L8-VL6-L9-VL5-L10-VH4; or VH4-L6-VL5-L7-VL6-L8-VH6-L9-VH5-L10-VL4; wherein VL1 is a first immunoglobulin light chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; VL2 is a second immunoglobulin light chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; VL3 is a third immunoglobulin light chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; VL4 is a fourth immunoglobulin light chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; VL5 is a fifth immunoglobulin light chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; VL6 is a sixth immunoglobulin light chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; VH1 is a first immunoglobulin heavy chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; VH2 is a second immunoglobulin heavy chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; VH3 is a third immunoglobulin heavy chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; VH4 is a fourth immunoglobulin heavy chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; VH5 is a fifth immunoglobulin heavy chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; VH6 is a sixth immunoglobulin heavy chain variable region that specifically binds to at least one epitope on at least one antigen selected from the group consisting of Env, gp160, gp120, gp41, p17, p24, p7, p55, p66, p31, Nef, Tat, Rev, Vif, Vpr and Vpu; L1, L2, L3, L4, L5, L6, L7, L8, L9 and L10 are amino acid linkers; wherein said antigen binding polypeptide complex further comprises at least one of the following (i)-(xxi): (i) an Fc region having an optional immunoglobulin hinge, wherein the immunoglobulin hinge comprises an upper hinge region, a middle hinge region, a lower hinge region, or a combination thereof; (ii) a linker selected from the group consisting of L1, L2, L3, L4, L5, L6, L7, L8, L9 and L10 having a length of from about 1 amino acid to about 50 amino acids; (iii) a linker selected from the group consisting of L1, L2, L3, L4, L5, L6, L7, L8, L9 and L10 selected from the group consisting of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 679, SEQ ID NO: 680, SEQ ID NO: 681, SEQ ID NO: 682, SEQ ID NO: 683, SEQ ID NO: 684, SEQ ID NO: 685, and SEQ ID NO: 686, or a sequence having at least 50%, at least 60%, at least 70%, at least 80%, at least 90%, or at least 95% identity to any one of SEQ ID NOs:1-19 and 679-686; (iv) a linker selected from the group consisting of L1, L2, L3, L4, L5, L6, L7, L8, L9 and L10 which is non-immunogenic; (v) a linker selected from the group consisting of L1, L2, L3, L4, L5, L6, L7, L8, L9 and L10 wherein said linker does not contain a consensus T cell epitope; (vi) an Fc region comprising at least one knob-into-hole modification; (vii) a detectable label; (viii) a detectable label selected from the group consisting of a radioactive label, chemiluminescent label, fluorescent label, enzyme, or peptide tag, or a combination thereof; (ix) a peptide tag; (x) a peptide tag selected from a polyhistidine tag consisting of from about 4 to about 10 histidine residues; (xi) a peptide tag having about 8 histidine residues; (xii) the polypeptide is conjugated to an agent to form an antibody-agent conjugate; (xiii) an antibody-agent conjugate wherein the agent is selected from the group consisting of a cytotoxic agent, an immunomodulating agent, an imaging agent, a therapeutic protein, or a combination thereof; (xiv) an antigen binding polypeptide having an equilibrium dissociation constant (KD) of from about 10 pM to about 1 pM when bound to an epitope on a target antigen or when complexed with another antigen binding polypeptide to form an antigen binding polypeptide complex having at least two antigen binding polypeptides; (xv) an antibody or antigen binding fragment thereof; (xvi) an antibody or antigen binding fragment thereof selected from the group consisting of IgG, IgM, IgE, IgA or IgD; (xvii) an antibody or antigen binding fragment thereof selected from an IgG antibody selected from the group consisting of IgG1, IgG2, IgG3 or IgG4; (xviii) an antibody or antigen binding fragment selected from the group consisting of Fab, scFab, Fab', F(ab')₂, Fv or scFv; (xix) an antigen binding polypeptide having an effector function mutation; (xx) an antigen binding polypeptide which, when formed into an antigen binding polypeptide complex, is an IgG1 or IgG4 antibody and the knob-into-hole modification comprises: (i) knob substitutions of S354C and T366W and hole substitutions of Y349C, T366S, L368A and Y407V; (ii) hole substitutions of L234A, L235A and P239A; (iii) hole substitutions of L234A and L235A; (iv) hole substitutions of M428L and N433S; (v) hole substitutions of M252Y, S254T and T256E; or (vi) a combination thereof, based on the EU numbering scheme; and (xxi) an antigen binding polypeptide as part of a chimeric receptor antigen. For the avoidance of doubt, all the antigen binding polypeptide structures described herein can be combined with any one or more of the HIV targets described herein. Any and all disclosure herein in relation to targets for antigen binding polypeptides of the invention is generally applicable, and applies equally and without reservation to each and every antigen binding polypeptide and antigen binding polypeptide complex described herein. For the avoidance of doubt, the VL1, VL2, VL3, VL4, VL5, VL6, VH1, VH2, VH3, VH4, VH5 and/or VH6 of each and every antigen binding polypeptide and antigen binding polypeptide complex described herein may independently bind to any one of said particularly preferred targets.

As used herein, an antigen binding polypeptide, antigen binding polypeptide complex (e.g., an antibody or antigen binding fragment thereof), or region or domain thereof that "specifically binds" refers to its association with an epitope by its antigen binding domain, and that the binding entails some complementarity between the antigen binding domain and the epitope. Specific binding to an epitope occurs where there is binding to that epitope via its antigen binding domain more readily than there would be binding to a random, unrelated epitope.

As used herein, an "epitope" refers to a localized region of an antigen to which an antigen binding polypeptide or antigen binding polypeptide complex (e.g., antibody or antigen binding fragment thereof) can specifically bind. An epitope can be, for example, contiguous amino acids of a polypeptide (linear or contiguous epitope) or an epitope can, for example, come together from two or more non-contiguous regions of a polypeptide or polypeptides (conformational, non-linear, discontinuous, or non-contiguous epitope). In some aspects, the epitope to which an antibody or antigen-binding fragment thereof binds can be determined by, e.g., NMR spectroscopy, X-ray diffraction crystallography studies, ELISA assays, hydrogen/deuterium exchange coupled with mass spectrometry (e.g., liquid chromatography electrospray mass spectrometry), array-based oligo-peptide scanning assays, and/or mutagenesis mapping (e.g., site-directed mutagenesis mapping). See, e.g., Giege R et al., (1994) Acta Crystallogr. D Biol. Crystallogr. 50(Pt 4): 339-350; McPherson A (1990) Eur. J. Biochem. 189: 1-23; Chayen N E (1997) Structure 5: 1269-1274; McPherson A (1976) J. Biol. Chem. 251: 6300-6303; Meth. Enzymol. (1985) volumes 114 & 115, eds Wyckoff H W et al., U.S. Pub. No. 2004/0014194), Bricogne G (1993) Acta Crystallogr. D Biol. Crystallogr. 49(Pt 1): 37-60, Bricogne G (1997) Meth. Enzymol. 276A: 361-423, ed Carter C W, and Roversi et al., (2000) Acta Crystallogr. D Biol. Crystallogr. 56(Pt 10): 1316-1323 (X-ray diffraction crystallography studies); and Champe et al., (1995) J. Biol. Chem. 270: 1388-1394 and Cunningham B C & Wells J A (1989) Science 244: 1081-1085 (mutagenesis mapping).

Specific binding can be represented by a "binding affinity." Binding affinity refers to an intrinsic binding affinity which reflects a 1:1 interaction between members of a binding pair (e.g., an antigen binding polypeptide or antigen binding polypeptide complex and an antigen). Binding affinity can be measured and/or expressed in several ways known in the art, including, but not limited to, equilibrium dissociation constant ($K_D$). $K_D$ is calculated from the quotient of $k_{off}/k_{on}$, where $k_{on}$ refers to the association rate constant of, e.g., an antigen binding polypeptide or antigen binding polypeptide complex to an antigen, and $k_{off}$ refers to the dissociation of, e.g., an antigen binding polypeptide or antigen binding polypeptide complex from an antigen. The $k_{on}$ and $k_{off}$ can be determined by techniques known to one of ordinary skill in the art, such as Octet BLI, BIAcore® or KinExA.

Accordingly, in some aspects, an antigen binding polypeptide complex of the invention is an antibody or antigen binding fragment thereof. In some aspects, the antibody or antigen binding fragment thereof comprises one, two or three antigen binding polypeptides described herein. In some aspects, the antibody or antigen binding fragment thereof is trispecific, tetraspecific, pentaspecific or hexaspecific. In other aspects, the antibody or antigen binding fragment thereof is trivalent, tetravalent, pentavalent or hexavalent.

In some aspects, the antibody or antigen binding fragment thereof specifically binds to an antigen with an equilibrium dissociation constant ($K_D$) of from about 10 μM to about 1 pM. In some aspects, the antibody is IgG, IgM, IgE, IgA or IgD. For example, the antibody may be IgG. For example, the antibody may be IgM. For example, the antibody may be IgE. For example, the antibody may be IgA. For example, the antibody may be IgD. In some aspects, the IgG is IgG1, IgG2, IgG3 or IgG4. For example, the antibody may be IgG1. For example, the antibody may be IgG2. For example, the antibody may be IgG3. For example, the antibody may be IgG4. In some aspects, the antigen binding fragment is a Fab, scFab, Fab', F(ab')$_2$, Fv or scFv. For example, the antigen binding fragment may be a Fab. For example, the antigen binding fragment may be a scFab. For example, the antigen binding fragment may be a Fab'. For example, the antigen binding fragment may be a F(ab')$_2$. For example, the antigen binding fragment may be a Fv. For example, the antigen binding fragment may be a scFv. In yet another aspect, the antibody is human or humanized. For example, the antibody may be human. For the example, the antibody may be humanized Amino Acid Linkers In some aspects, an antigen binding polypeptide or antigen binding polypeptide complex (e.g., an antibody or antigen binding fragment thereof) of the invention comprises one or more amino acid linkers between one or more regions of the antigen binding polypeptide or antigen binding polypeptide complex.

As used herein, an "amino acid linker" refers to a single amino acid or short amino acid sequence that is capable of joining two polypeptide regions of the invention described herein in a stable manner that maintains or promotes a function associated with the polypeptide regions. In some aspects, an amino acid linker is represented herein in a structure of an antigen binding polypeptide or antigen binding polypeptide complex by the abbreviation "l" or "L" and a number (e.g., L1 to denote a first linker, L2 to denote a second linker, L3 to denote a third linker, L4 to denote a fourth linker, L5 to denote a fifth linker, L6 to denote a sixth linker, L7 to denote a seventh linker, L8 to denote an eighth linker, L9 to denote a ninth linker, L10 to denote a tenth linker, L11 to denote an eleventh linker, L12 to denote a twelfth linker, L13 to denote a thirteenth linker, and so on). In some aspects, such enumerated amino acid linkers (e.g., L1) can have the same or different sequence as any other enumerated amino acid linker (e.g., L2, etc.). Furthermore, in other aspects, an enumerated amino acid linker present in one polypeptide (e.g., L1 on a first polypeptide of an antigen binding polypeptide and/or antigen binding polypeptide complex structure described herein) can have the same or different sequence as the same enumerated amino acid linker present in another polypeptide (e.g., L1 on a second polypeptide, third polypeptide, etc. of an antigen binding polypeptide and/or antigen binding polypeptide complex structure described herein).

In some aspects, an amino acid linker has a length of from about 1 amino acid to about 50 amino acids (e.g., one or more of L1, L2, L3, L4, L5, L6, L7, L8, L9, L10, L11, L12, L13 etc. of an antigen binding polypeptide or a first, second, third, etc. polypeptide of an antigen binding polypeptide complex structure described herein). In some aspects, the amino acid linker has a length of from about 1 amino acid to about 45 amino acids, about 1 amino acid to about 40 amino acids, about 1 amino acid to about 35 amino acids, about 1 amino acid to about 30 amino acids, about 1 amino acid to about 25 amino acids, about 1 amino acid to about 20 amino acids, 1 amino acid to about 15 amino acids, about 1 amino acid to about 10 amino acids, about 1 amino acid to about 5 amino acids, about 5 amino acids to about 50 amino acids, about 5 amino acids to about 45 amino acids, about 5 amino acids to about 40 amino acids, about 5 amino acids to about 35 amino acids, about 5 amino acids to about 30 amino acids, about 5 amino acids to about 25 amino acids, about 5 amino acids to about 20 amino acids, about 5 amino acids to about 15 amino acids, about 5 amino acids to about 10 amino acids, about 10 amino acids to about 50 amino acids, about 10 amino acids to about 45 amino acids, about 10 amino acids to about 40 amino acids, about 10 amino acids to about 35 amino acids, about 10 amino acids to about 30 amino acids, about 10 amino acids to about 25 amino acids, about 10 amino acids to about 20 amino acids, about 10 amino acids to about 15 amino acids, about 15 amino acids to about 50 amino acids, about 15 amino acids to about 45 amino acids, about 15 amino acids to about 40 amino acids, about 15 amino acids to about 35 amino acids, about 15 amino acids to about 30 amino acids, about 15 amino acids to about 25 amino acids, about 15 amino acids to about 20 amino acids, about 20 amino acids to about 50 amino acids, about 20 amino acids to about 45 amino acids, about 20 amino acids to about 40 amino acids, about 20 amino acids to about 35 amino acids, about 20 amino acids to about 30 amino acids, about 20 amino acids to about 25 amino acids, about 25 amino acids to about 50 amino acids, about 25 amino acids to about 45 amino acids, about 25 amino acids to about 40 amino acids, about 25 amino acids to about 35 amino acids, about 25 amino acids to about 30 amino acids, about 30 amino acids to about 50 amino acids, about 30 amino acids to about 45 amino acids, about 30 amino acids to about 40 amino acids, about 30 amino acids to about 35 amino acids, about 35 amino acids to about 50 amino acids, about 40 amino acids to about 45 amino acids, or about 45 amino acids to about 50 amino acids.

In some aspects, the amino acid linker has about 1, about 2, about 3, about 4, about 5, about 6, about 7, about 8, about 9, about 10, about 11, about 12, about 13, about 14, about 15, about 16, about 17, about 18, about 19, about 20, about 25, about 30, about 35, about 40, about 45, or about 50 amino acids (e.g., one or more of L1, L2, L3, L4, L5, L6, L7, L8, L9, L10, L11, L12, L13, etc. of an antigen binding polypeptide structure described herein or a first, second, third, etc. polypeptide of an antigen binding polypeptide complex structure described herein).

In some aspects, the amino acid linker consists of one or more amino acid residues (e.g., one or more of L1, L2, L3, L4, L5, L6, L7, L8, L9, L10, L11, L12, L13, etc. of an antigen binding polypeptide structure described herein or a first, second, third, etc. polypeptide of an antigen binding polypeptide complex structure described herein). In some aspects, the amino acid residues are selected from the group consisting of glycine, alanine, serine, threonine, cysteine, asparagine, glutamine, leucine, isoleucine, valine, proline, histidine, aspartic acid, glutamic acid, lysine, arginine, methionine, phenylalanine, tryptophan, and tyrosine.

In some aspects, an amino acid linker of the invention is non-immunogenic. In some aspects, the non-immunogenic linker consists of serine, glycine and/or alanine residues, or consists of serine and/or glycine residues. In some aspects, an amino acid linker of the invention does not contain a T cell epitope or consensus T cell epitope.

In some aspects, the amino acid linker consists of one or more residues of alanine, cysteine, glycine, isoleucine, leucine, methionine, phenylalanine, proline, tryptophan, tyrosine, valine (e.g., one or more of L1, L2, L3, L4, L5, L6, L7, L8, L9, L10, L11, L12, L13, etc. of an antigen binding polypeptide structure described herein or a first, second, third, etc. polypeptide of an antigen binding polypeptide complex structure described herein).

Amino acid linker sequences that can be used with the antigen binding polypeptides and antigen binding polypeptide complexes (e.g., an antibody or antigen binding fragment thereof) of the invention are well known and can be incorporated into antigen binding polypeptides and antigen binding polypeptide complexes of the invention using routine molecular biology and recombinant DNA techniques. See, e.g., Chen et al., Adv Drug Deliv Rev., 65(10):1357-1369, 2013; and Chichili et al., Protein Sci., 22(2):153-167, 2013.

In some aspects, the amino acid linker (e.g., one or more of L1, L2, L3, L4, L5, L6, L7, L8, L9, L10, L11, L12, L13, etc. of a first, second, third, etc. polypeptide of an antigen binding polypeptide or antigen binding polypeptide complex structure described herein) has the sequence of g, a, gss, asg, ggssg, gssgs, gtvaa, asggs, astgg, asggsg, ggsggssgss, sggsgssggs, ggsggsgsgggsasgsg, ggsggsgsgggsasgsg, gggssggggsggsgsggsgs, ggggsggsgsgggsasgsg, gggssggsgsggsgsggsgs, sggssggsgsgggsgsggsggssg, gsgssgggsggsgsggsgssg, ggggsgsggsggsssgggsgsgggsgggsgsgggsggggs, ggggsgggsgggsggsgggsgsgggsgggsgggsggggs, ggggsgsggsggsssgggsgsgggsgggsgggsgggsggggssss, ggggsgsggsggsssgggsgsgggsgggsgggsgggsggggsssgs, ggsgg, gsggsagsgsggggsasgsg, ggggs, or gsggsggsgsgggsasgsg (SEQ ID NOs:1-19 and 679-686), or a sequence having at least 50%, at least 60%, at least 70%, at least 80%, at least 90%, at least 91%, at least 92%, at least 93%, at least 94%, at least 95%, at least 96%, at least 97%, at least 98%, at least 99% or 100% identity to any one of SEQ ID NOs:1-19 and 679-686. For example, the amino acid linker (e.g., one or more of L1, L2, L3, L4, L5, L6, L7, L8, L9, L10, L11, L12 etc. of a first, second, third, etc. polypeptide of an antigen binding polypeptide or antigen binding polypeptide complex structure described herein) may comprise the amino acid sequence of any one of SEQ ID NOs: 1-19 and 679-686.

In some aspects, an antigen binding polypeptide or antigen binding polypeptide complex of the invention comprises a polypeptide having a structure represented by VL1-L1-VL2-L2-VL3-L3-VH3-L4-VH2-L5-VH1; VH1-L1-VH2-L2-VH3-L3-VL3-L4-VL2-L5-VL1; VL1-L1-VH2-L2-VL3-L3-VH3-L4-VL2-L5-VH1; VH1-L1-VL2-L2-VH3-L3-VL3-L4-VH2-L5-VL1; VL1-L1-VL2-L2-VH3-L3-VL3-L4-VH2-L5-VH1; VH1-L1-VH2-L2-VL3-L3-VH3-L4-VL2-L5-VL1; VL1-L1-VH2-L2-VH3-L3-VL3-L4-VL2-L5-VH1; or VH1-L1-VL2-L2-VL3-L3-VH3-L4-VH2-L5-VL1. In some aspects, L1 comprises the amino acid sequence of ggssg (SEQ ID NO:1) or an amino acid sequence having at least 90% identity or at least 95% identity to SEQ ID NO:1. In some aspects, L2 comprises the amino acid sequence of ggssg (SEQ ID NO:1) or an amino acid sequence having at least 90% identity or at least 95% identity to SEQ ID NO:1. In some aspects, L3 comprises the amino acid sequence of ggggsggsgsggggsasgsg (SEQ ID NO:12) or an amino acid sequence having at least 90% identity or at least 95% identity to SEQ ID NO:12. In some aspects, L4 comprises the amino acid sequence of ggssg (SEQ ID NO:1) or an amino acid sequence having at least 90% identity or at least 95% identity to SEQ ID NO:1. In some aspects, L5 comprises the amino acid sequence of ggssg (SEQ ID NO:1) or an amino acid sequence having at least 90% identity or at least 95% identity to SEQ ID NO:1. For example, L1 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L1 may comprise the amino acid sequence of SEQ ID NO:1. For example, L2 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L2 may comprise the amino acid sequence of SEQ ID NO:1. For example, L3 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:12. For example, L3 may comprise the amino acid sequence of SEQ ID NO:12. For example, L4 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L4 may comprise the amino acid sequence of SEQ ID NO:1. For example, L5 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L5 may comprise the amino acid sequence of SEQ ID NO:1.

In some aspects, an antigen binding polypeptide or antigen binding polypeptide complex of the invention comprises a polypeptide having a structure represented by VL1-L1-VL2-L2-VL3-L3-VH3-L4-VH2-L5-VH1-L6; VH1-L1-VH2-L2-VH3-L3-VL3-L4-VL2-L5-VL1-L6; VH1-L1-VH2-L2-VL3-L3-VH3-L4-VL2-L5-VH1-L6; VL1-L1-VL2-L2-VH3-L3-VL3-L4-VH2-L5-VL1-L6; VL1-L1-VL2-L2-VH3-L3-VL3-L4-VH2-L5-VH1-L6; VH1-L1-VH2-L2-VL3-L3-VH3-L4-VL2-L5-VL1-L6; VL1-L1-VH2-L2-VH3-L3-VL3-L4-VL2-L5-VH1-L6; or VH1-L1-VL2-L2-VL3-L3-VH3-L4-VH2-L5-VL1-L6. In some aspects, L1 comprises the amino acid sequence of ggssg (SEQ ID NO:1) or an amino acid sequence having at least 90% identity or at least 95% identity to SEQ ID NO:1. In some aspects, L2 comprises the amino acid sequence of ggssg (SEQ ID NO:1) or an amino acid sequence having at least 90% identity or at least 95% identity to SEQ ID NO:1. In some aspects, L3 comprises the amino acid sequence of ggggsggsgsggggsasgsg (SEQ ID NO:12) or an amino acid sequence having at least 90% identity or at least 95% identity to SEQ ID NO:12. In some aspects, L4 comprises the amino acid sequence of ggssg (SEQ ID NO:1) or an amino acid sequence having at least 90% identity or at least 95% identity to SEQ ID NO:1. In some aspects, L5 comprises the amino acid sequence of ggssg (SEQ ID NO:1) or an amino acid sequence having at least 90% identity or at least 95% identity to SEQ ID NO:1. In some aspects, L6 comprises the amino acid sequence of ggssg (SEQ ID NO:1) or an amino acid sequence having at least 90% identity or at least 95% identity to SEQ ID NO:1. In some aspects, L6 comprises the amino acid sequence of asggsg (SEQ ID NO:6) or an amino acid sequence having at least 90% identity or at least 95% identity to SEQ ID NO:6. For example, L1 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L1 may comprise the amino acid sequence of SEQ ID NO:1. For example, L2 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L2 may comprise the amino acid sequence of SEQ ID NO:1. For example, L3 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:12. For example, L3 may comprise the amino acid sequence of SEQ ID NO:12. For example, L4 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L4 may comprise the amino acid sequence of SEQ ID NO:1. For example, L5 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L5 may comprise the amino acid sequence of SEQ ID NO:1. For example, L6 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:6. For example, L6 may comprise the amino acid sequence of SEQ ID NO:6.

In some aspects, an antigen binding polypeptide or antigen binding polypeptide complex of the invention comprises a polypeptide having a structure represented by VL1-L1-VL2-L2-VL3-L3-VH3-L4-VH2-L5-VH1-L6-Fc; VH1-L1-VH2-L2-VH3-L3-VL3-L4-VL2-L5-VL1-L6-Fc; VL1-L1-VH2-L2-VL3-L3-VH3-L4-VL2-L5-VH1-L6-Fc; VH1-L1-VL2-L2-VH3-L3-VL3-L4-VH2-L5-VL1-L6-Fc; VL1-L1-VL2-L2-VH3-L3-VL3-L4-VH2-L5-VH1-L6-Fc; VH1-L1-VH2-L2-VL3-L3-VH3-L4-VL2-L5-VL1-L6-Fc; VL1-L1-VH2-L2-VH3-L3-VL3-L4-VL2-L5-VH1-L6-Fc; or VH1-L1-VL2-L2-VL3-L3-VH3-L4-VH2-L5-VL1-L6-Fc. In some aspects, L1 comprises the amino acid sequence of ggssg (SEQ ID NO:1) or an amino acid sequence having at least 90% identity or at least 95% identity to SEQ ID NO:1. In some aspects, L2 comprises the amino acid sequence of ggssg (SEQ ID NO:1) or an amino acid sequence having at least 90% identity or at least 95% identity to SEQ ID NO:1. In some aspects, L3 comprises the amino acid sequence of ggggsggsgsggggsasgsg (SEQ ID NO:12) or an amino acid sequence having at least 90% identity or at least 95% identity to SEQ ID NO:12. In some aspects, L4 comprises the amino acid sequence of ggssg (SEQ ID NO:1) or an amino acid sequence having at least 90% identity or at least 95% identity to SEQ ID NO:1. In some aspects, L5 comprises the amino acid sequence of ggssg (SEQ ID NO:1) or an amino acid sequence having at least 90% identity or at least 95% identity to SEQ ID NO:1. In some aspects, L6 comprises the amino acid sequence of asggsg (SEQ ID NO:6) or an amino acid sequence having at least 90% identity or at least 95% identity to SEQ ID NO:6. For example, L1 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L1 may comprise the amino acid sequence of SEQ ID NO:1. For example, L2 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L2 may comprise the amino acid sequence of SEQ ID NO:1. For example, L3 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:12. For example, L3 may comprise the amino acid sequence of SEQ ID NO:12. For example, L4 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L4 may comprise the amino acid sequence of SEQ ID NO:1. For example, L5 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L5 may comprise the amino acid sequence of SEQ ID NO:1. For example, L6 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:6. For example, L6 may comprise the amino acid sequence of SEQ ID NO:6.

In some aspects, an antigen binding polypeptide or antigen binding polypeptide complex of the invention comprises a polypeptide having a structure represented by VL1-L1-VL2-L2-VL3-L3-VH3-L4-VH2-L5-VH1-L6-Fc-L7-Fc; VH1-L1-VH2-L2-VH3-L3-VL3-L4-VL2-L5-VL1-L6-Fc-L7-Fc; VL1-L1-VH2-L2-VL3-L3-VH3-L4-VL2-L5-VH1-L6-Fc-L7-Fc; VH1-L1-VL2-L2-VH3-L3-VL3-L4-VH2-L5-VL1-L6-Fc-L7-Fc; VL1-L1-VL2-L2-VH3-L3-VL3-L4-VH2-L5-VH1-L6-Fc-L7-Fc; VH1-L1-VH2-L2-VL3-L3-VH3-L4-VL2-L5-VL1-L6-Fc-L7-Fc; VL1-L1-VH2-L2-VH3-L3-VL3-L4-VL2-L5-VH1-L6-Fc-L7-Fc; or VH1-L1-VL2-L2-VL3-L3-VH3-L4-VH2-L5-VL1-L6-Fc-L7-Fc. In some aspects, L1 comprises the amino acid sequence of ggssg (SEQ ID NO:1) or an amino acid sequence having at least 90% identity or at least 95% identity to SEQ ID NO:1. In some aspects, L2 comprises the amino acid sequence of ggssg (SEQ ID NO:1) or an amino acid sequence having at least 90% identity or at least 95% identity to SEQ ID NO:1. In some aspects, L3 comprises the amino acid sequence of ggggsggsgsggggsasgsg (SEQ ID NO:12) or an amino acid sequence having at least 90% identity or at least 95% identity to SEQ ID NO:12. In some aspects, L4 comprises the amino acid sequence of ggssg (SEQ ID NO:1) or an amino acid sequence having at least 90% identity or at least 95% identity to SEQ ID NO:1. In some aspects, L5 comprises the amino acid sequence of ggssg (SEQ ID NO:1) or an amino acid sequence having at least 90% identity or at least 95% identity to SEQ ID NO:1. In some aspects, L6 comprises the amino acid sequence of asggsg (SEQ ID NO:6) or an amino acid sequence having at least 90% identity or at least 95% identity to SEQ ID NO:6. In some aspects, L7 comprises the amino acid sequence of ggggsgsggsgggssgggsgsggggsgggsggggsgggs (SEQ ID NO:16) or an amino acid sequence having at least 90% identity or at least 95% identity to SEQ ID NO:16. In some aspects, L7 comprises the amino acid sequence of ggggsgsggsgggssgggsggggsggggsggggsggggssss (SEQ ID NO:18) or an amino acid sequence having at least 90% identity or at least 95% identity to SEQ ID NO:18. In some aspects, L7 comprises the amino acid sequence of ggggsgsggsgggssgggsggggsggggsggggsggggsssssgs (SEQ ID NO:19) or an amino acid sequence having at least 90% identity or at least 95% identity to SEQ ID NO:19. For example, L1 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L1 may comprise the amino acid sequence of SEQ ID NO:1. For example, L2 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L2 may comprise the amino acid sequence of SEQ ID NO:1. For example, L3 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:12. For example, L3 may comprise the amino acid sequence of SEQ ID NO:12. For example, L4 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L4 may comprise the amino acid sequence of SEQ ID NO:1. For example, L5 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L5 may comprise the amino acid sequence of SEQ ID NO:1. For example, L6 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:6. For example, L6 may comprise the amino acid sequence of SEQ ID NO:6. For example, L7 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:16. For example, L7 may comprise the amino acid sequence of SEQ ID NO:16. For example, L7 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:18. For example, L7 may comprise the amino acid sequence of SEQ ID NO:18. For example, L7 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:19. For example, L7 may comprise the amino acid sequence of SEQ ID NO:19.

In some aspects, an antigen binding polypeptide or antigen binding polypeptide complex of the invention comprises a polypeptide having a structure represented by VL1-L1-VL2-L2-VL3-L3-VH3-L4-VH2-L5-VH1-L6-CH3-L7-CH3; VH1-L1-VH2-L2-VH3-L3-VL3-L4-VL2-L5-VL1-

L6-CH3-L7-CH3; VL1-L1-VH2-L2-VL3-L3-VH3-L4-VL2-L5-VH1-L6-CH3-L7-CH3; VH1-L1-VL2-L2-VH3-L3-VL3-L4-VH2-L5-VL1-L6-CH3-L7-CH3; VL1-L1-VL2-L2-VH3-L3-VL3-L4-VH2-L5-VH1-L6-CH3-L7-CH3; VH1-L1-VH2-L2-VL3-L3-VH3-L4-VL2-L5-VL1-L6-CH3-L7-CH3; VL1-L1-VH2-L2-VH3-L3-VL3-L4-VL2-L5-VH1-L6-CH3-L7-CH3; or VH1-L1-VL2-L2-VL3-L3-VH3-L4-VH2-L5-VL1-L6-CH3-L7-CH3. In some aspects, L1 comprises the amino acid sequence of ggssg (SEQ ID NO:1) or an amino acid sequence having at least 90% identity or at least 95% identity to SEQ ID NO:1. In some aspects, L2 comprises the amino acid sequence of ggssg (SEQ ID NO:1) or an amino acid sequence having at least 90% identity or at least 95% identity to SEQ ID NO:1. In some aspects, L3 comprises the amino acid sequence of ggggsggsgsgggsasgsg (SEQ ID NO:12) or an amino acid sequence having at least 90% identity or at least 95% identity to SEQ ID NO:12. In some aspects, L4 comprises the amino acid sequence of ggssg (SEQ ID NO:1) or an amino acid sequence having at least 90% identity or at least 95% identity to SEQ ID NO:1. In some aspects, L5 comprises the amino acid sequence of ggssg (SEQ ID NO:1) or an amino acid sequence having at least 90% identity or at least 95% identity to SEQ ID NO:1. In some aspects, L6 comprises the amino acid sequence of asggsg (SEQ ID NO:6) or an amino acid sequence having at least 90% identity or at least 95% identity to SEQ ID NO:6. In some aspects, L7 comprises the amino acid sequence of gggssgggsggsgsggsgs (SEQ ID NO:11) or an amino acid sequence having at least 90% identity or at least 95% identity to SEQ ID NO:11. In some aspects, L7 comprises the amino acid sequence of gggssggsgsggsgsggsgs (SEQ ID NO:13) or an amino acid sequence having at least 90% identity or at least 95% identity to SEQ ID NO:13. In some aspects, L7 comprises the amino acid sequence of sggssggsgsggsgsggsgssg (SEQ ID NO:14) or an amino acid sequence having at least 90% identity or at least 95% identity to SEQ ID NO:14. In some aspects, L7 comprises the amino acid sequence of gsgssggggsggsgsggsgssg (SEQ ID NO:15) or an amino acid sequence having at least 90% identity or at least 95% identity to SEQ ID NO:15. For example, L1 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L1 may comprise the amino acid sequence of SEQ ID NO:1. For example, L2 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L2 may comprise the amino acid sequence of SEQ ID NO:1. For example, L3 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:12. For example, L3 may comprise the amino acid sequence of SEQ ID NO:12. For example, L4 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L4 may comprise the amino acid sequence of SEQ ID NO:1. For example, L5 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L5 may comprise the amino acid sequence of SEQ ID NO:1. For example, L6 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:6. For example, L6 may comprise the amino acid sequence of SEQ ID NO:6. For example, L7 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:11. For example, L7 may comprise the amino acid sequence of SEQ ID NO:11. For example, L7 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:13. For example, L7 may comprise the amino acid sequence of SEQ ID NO:13. For example, L7 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:14. For example, L7 may comprise the amino acid sequence of SEQ ID NO:14. For example, L7 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:15. For example, L7 may comprise the amino acid sequence of SEQ ID NO:15.

In some aspects, a second polypeptide of an antigen binding polypeptide complex described herein comprises a polypeptide having a structure represented by VL4-VH4; VH4-VL4; VL4-L6-VH4; or VH4-L6-VL4. For example, the second polypeptide may have the structure VL4-VH4. For example, the second polypeptide may have the structure VH4-VL4. For example, the second polypeptide may have the structure VL4-L6-VH4. For example, the second polypeptide may have the structure VH4-L6-VL4. In some aspects, L6 comprises the amino acid sequence of ggggsggsgsgggsasgsg (SEQ ID NO:12) or an amino acid sequence having at least 90% identity (such as at least 91%, at least 92%, at least 93%, at least 94%, at least 95%, at least 96%, at least 97%, at least 98%, at least 99% or 100% identity) to SEQ ID NO:12. For example, L6 may comprise the amino acid sequence of SEQ ID NO:12. In some aspects, VH4 comprises an amino acid sequence having at least 90% identity, at least 95% identity, or 100% identity to SEQ ID NO:23. For example, VH4 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:23. For example, VH4 may comprise the amino acid sequence of SEQ ID NO:23. In some aspects, VL4 comprises an amino acid sequence having at least 90% identity, at least 95% identity, or 100% identity to SEQ ID NO:28. For example, VL4 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:28. For example, VL4 may comprise the amino acid sequence of SEQ ID NO:28. In some aspects, VH4 comprises an amino acid sequence having at least 90% identity, at least 95% identity, or 100% identity to SEQ ID NO:23 and VL4 comprises an amino acid sequence having at least 90% identity, at least 95% identity, or 100% identity to SEQ ID NO:28. For example, VH4 may comprise an amino acid sequence having at least 90% identity to SEQ ID NO:23 and VL4 may comprise an amino acid sequence having at least 90% identity to SEQ ID NO:28. At least 90% identity may include at least 91%, 92%, 93%, 94%, 95%, 96%, 97%, 98%, 99% or 100% identity to the reference polypeptide sequence. For example, VH4 may comprise the amino acid sequence of SEQ ID NO:23 and VL4 may comprise the amino acid sequence of SEQ ID NO:28.

In some aspects, a second polypeptide of an antigen binding polypeptide complex described herein comprises a polypeptide having a structure represented by VL4-VH4-CL-Fc; VH4-VL4-CL-Fc; VL4-L7-VH4-L8-CL-Fc; or VH4-L7-VL4-L8-CL-Fc. For example, the second polypeptide may have the structure VL4-VH4-CL-Fc. For example, the second polypeptide may have the structure VH4-VL4-CL-Fc. For example, the second polypeptide may have the structure VL4-L7-VH4-L8-CL-Fc. For example, the second polypeptide may have the structure VH4-L7-VL4-L8-CL-Fc. In some aspects, VH4 comprises an amino acid sequence having at least 90% identity, at least 95% identity, or 100% identity to SEQ ID NO:23. For example, VH4 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:23. For example, VH4 may comprise the amino acid sequence of SEQ ID NO:23. In some aspects, VL4 comprises an amino acid sequence having at least 90% identity, at least 95% identity, or 100% identity to SEQ ID NO:28. For example, VL4 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:28. For example, VL4 may comprise the amino acid sequence of SEQ ID NO:28. In some aspects, VH4 comprises an amino acid sequence having at least 90% identity, at least 95% identity, or 100% identity to SEQ ID NO:23 and VL4 comprises an amino acid sequence having at least 90% identity, at least 95% identity, or 100% identity to SEQ ID NO:28. For example, VH4 may comprise an amino acid sequence having at least 90% identity to SEQ ID NO:23 and VL4 may comprise an amino acid sequence having at least 90% identity to SEQ ID NO:28. At least 90% identity may include at least 91%, 92%, 93%, 94%, 95%, 96%, 97%, 98%, 99% or 100% identity to the reference polypeptide sequence. For example, VH4 may comprise the amino acid sequence of SEQ ID NO:23 and VL4 may comprise the amino acid sequence of SEQ ID NO:28. In some aspects, L7 comprises the amino acid sequence of ggggsggsgsggggsasgsg (SEQ ID NO:12) or an amino acid sequence having at least 90% identity (such as at least 91%, at least 92%, at least 93%, at least 94%, at least 95%, at least 96%, at least 97%, at least 98%, at least 99% or 100% identity) to SEQ ID NO:12. For example, L7 may comprise the amino acid sequence of SEQ ID NO: 12. In some aspects, L8 comprises the amino acid sequence of asggs (SEQ ID NO:4) or an amino acid sequence having at least 90% identity (such as at least 91%, at least 92%, at least 93%, at least 94%, at least 95%, at least 96%, at least 97%, at least 98%, at least 99% or 100% identity) to SEQ ID NO:4. For example, L8 may comprise the amino acid sequence of SEQ ID NO: 4. In some aspects, the second polypeptide comprises an amino acid sequence having at least 90% identity, at least 95% identity or 100% identity to SEQ ID NO:44. For example, the second polypeptide may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:44. For example, the second polypeptide may comprise the amino acid sequence of SEQ ID NO:44. In some aspects, the second polypeptide comprises an amino acid sequence encoded by a polynucleotide having at least 90% identity, at least 95% identity or 100% identity to SEQ ID NO:61. For example, the second polypeptide may comprise an amino acid sequence encoded by a polynucleotide having at least 90% identity (such as at least 91%, at least 92%, at least 93%, at least 94%, at least 95%, at least 96%, at least 97%, at least 98%, at least 99% or 100% identity) to SEQ ID NO:61. For example, the second polypeptide may comprise an amino acid sequence encoded by the polynucleotide of SEQ ID NO: 61.

In some aspects, the second polypeptide of an antigen binding polypeptide complex of the invention comprises a polypeptide having a structure represented by VL4-VL5-VH5-VH4; VH4-VH5-VL5-VL4; VL4-L6-VL5-L7-VH5-L8-VH4; or VH4-L6-VH5-L7-VL5-L8-VL4. For example, the second polypeptide may have the structure VL4-VL5-VH5-VH4. For example, the second polypeptide may have the structure VH4-VH5-VL5-VL4. For example, the second polypeptide may have the structure VL4-L6-VL5-L7-VH5-L8-VH4. For example, the second polypeptide may have the structure VH4-L6-VH5-L7-VL5-L8-VL4. In some aspects, VH4 comprises an amino acid sequence having at least 90% identity, at least 95% identity, or 100% identity to SEQ ID NO:23. For example, VH4 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:23. For example, VH4 may comprise the amino acid sequence of SEQ ID NO:23. In some aspects, VL4 comprises an amino acid sequence having at least 90% identity, at least 95% identity, or 100% identity to SEQ ID NO:28. For example, VL4 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:28. For example, VL4 may comprise the amino acid sequence of SEQ ID NO:28. In some aspects, VH5 comprises an amino acid sequence having at least 90% identity, at least 95% identity, or 100% identity to SEQ ID NO:24. For example, VH5 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:24. For example, VH5 may comprise the amino acid sequence of SEQ ID NO:24. In some aspects, VL5 comprises an amino acid sequence having at least 90% identity, at least 95% identity, or 100% identity to SEQ ID NO:29. For example, VL5 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:29. For example, VL5 may comprise the amino acid sequence of SEQ ID NO:29. In some aspects, L6 is GGSSG (SEQ ID NO:1) or an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L6 may comprise the amino acid sequence of SEQ ID NO: 1. In some aspects, L7 is GGGGSGGSGSGGGGSASGSG (SEQ ID NO:12) or an amino acid sequence having at least 90% identity (such as at least 91%, at least 92%, at least 93%, at least 94%, at least 95%, at least 96%, at least 97%, at least 98%, at least 99% or 100% identity) to SEQ ID NO:12. For example, L7 may comprise the amino acid sequence of SEQ ID NO: 12.

In some aspects, the second polypeptide of an antigen binding polypeptide complex of the invention comprises a polypeptide having a structure represented by VL4-VL5-VH5-VH4-Fc; VH4-VH5-VL5-VL4-Fc; VL4-L6-VL5-L7-VH5-L8-VH4-L9-Fc; or VH4-L6-VH5-L7-VL5-L8-VL4-L9-Fc. For example, the second polypeptide may have the structure VL4-VL5-VH5-VH4-Fc. For example, the second polypeptide may have the structure VH4-VH5-VL5-VL4-Fc. For example, the second polypeptide may have the structure VL4-L6-VL5-L7-VH5-L8-VH4-L9-Fc. For example, the second polypeptide may have the structure VH4-L6-VH5-L7-VL5-L8-VL4-L9-Fc. In some aspects, VH4 comprises an amino acid sequence having at least 90% identity, at least 95% identity, or 100% identity to SEQ ID NO:23 or 24. For example, VH4 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:23 or 24. For example, VH4 may comprise the amino acid sequence of SEQ ID NO:23 or 24. In some aspects, VL4 comprises an amino acid sequence having at least 90% identity, at least 95% identity, or 100% identity to SEQ ID NO:28 or 29. For example, VL4 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:28 or 29. For example, VL4 may comprise the amino acid sequence of SEQ ID NO:28 or 29. In some aspects, VH5 comprises an amino acid sequence having at least 90% identity, at least 95% identity, or 100% identity to SEQ ID NO:23 or 24. For example, VH5 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:23 or 24. For example, VH5 may comprise the amino acid sequence of SEQ ID NO: 23 or 24. In some aspects, VL5 comprises an amino acid sequence having at least 90% identity, at least 95% identity, or 100% identity to SEQ ID NO:28 or 29. For example, VL5 may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO: 28 or 29. For example, VL5 may comprise the amino acid sequence of SEQ ID NO:28 or 29. In some aspects, L6 is GGSSG (SEQ ID NO:1) or an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For example, L6 may comprise the amino acid sequence of SEQ ID NO: 1. In some aspects, L7 is GGGGSGGSGSGGGGSASGSG (SEQ ID NO:12) or an amino acid sequence having at least 90% identity (such as at least 91%, at least 92%, at least 93%, at least 94%, at least 95%, at least 96%, at least 97%, at least 98%, at least 99% or 100% identity) to SEQ ID NO:12. For example, L7 may comprise the amino acid sequence of SEQ ID NO: 12. In some aspects, L8 is GGSSG (SEQ ID NO:1) or an amino acid sequence having at least 90% identity (such as at least 91%, at least 92%, at least 93%, at least 94%, at least 95%, at least 96%, at least 97%, at least 98%, at least 99% or 100% identity) to SEQ ID NO:1. For Example, L8 may comprise the amino acid sequence of SEQ ID NO:1. In some aspects, L9 is ASGGSG (SEQ ID NO:6) or an amino acid sequence having at least 90% identity (such as at least 91%, at least 92%, at least 93%, at least 94%, at least 95%, at least 96%, at least 97%, at least 98%, at least 99% or 100% identity) to SEQ ID NO:6. For example, L9 may comprise the amino acid sequence of SEQ ID NO: 6. In some aspects, the second polypeptide comprises an amino acid sequence having at least 90% identity, at least 95% identity or 100% identity to SEQ ID NO:45 or 46. For example, the second polypeptide may comprise an amino acid sequence having at least 90% identity (such as at least 91%, at least 92%, at least 93%, at least 94%, at least 95%, at least 96%, at least 97%, at least 98%, at least 99% or 100% identity) to SEQ ID NO:45 or 46. For example, the second polypeptide may comprise the amino acid sequence of SEQ ID NO:45 or 46. In some aspects, the second polypeptide comprises an amino acid sequence encoded by a polynucleotide having at least 90% identity, at least 95% identity or 100% identity to SEQ ID NO:62 or 63. For example, the second polypeptide may comprise an amino acid sequence encoded by a polynucleotide having at least 90% identity (such as at least 91%, at least 92%, at least 93%, at least 94%, at least 95%, at least 96%, at least 97%, at least 98%, at least 99% or 100% identity) to SEQ ID NO:62 or 63. For example, the second polypeptide may comprise an amino acid sequence encoded by the polynucleotide of SEQ ID NO: 62 or 63.

Detectable Labels and Drug Conjugates

In some aspects, an antigen binding polypeptide or antigen binding polypeptide complex (e.g., an antibody or antigen binding fragment thereof) of the invention comprises one or more detectable labels. An antigen binding polypeptide or antigen binding polypeptide complex (e.g., an antibody or antigen binding fragment thereof) containing a detectable label is useful in therapeutic, diagnostic, imaging (e.g., radioimaging), or basic research applications.

In some aspects, the detectable label is a radioactive label. Examples of a radioactive label include, but are not limited to, the isotopes $^{3}$H, $^{14}$C, $^{32}$P, $^{35}$S, $^{36}$Cl, $^{51}$Cr, $^{57}$Co, $^{58}$Co, $^{59}$Fe, $^{90}$Y, $^{121}$I, $^{124}$I, $^{125}$I, $^{131}$I, $^{111}$In, $^{117}$Lu, $^{211}$At, $^{198}$Au, $^{67}$Cu, $^{225}$Ac, $^{213}$Bi, $^{99}$Tc, $^{186}$Re and $^{89}$Zr.

In some aspects, the detectable label is a chemiluminescent label, fluorescent label, enzyme, biotin, or a combination thereof.

In some aspects, the detectable label is a peptide tag. In some aspects, the peptide tag is located at the N-terminus of the polypeptide or polypeptide complex. In some aspects, the peptide tag is located at the C-terminus of the polypeptide or polypeptide complex. In some aspects, the peptide tag is an affinity tag or fusion tag.

In some aspects, the detectable label is a polyhistidine tag, polyarginine tag, glutathione-S-transferase (GST), maltose binding protein (MBP), chitin binding protein (CBP), Strep-tag, thioredoxin (TRX), poly(NANP), FLAG tag, ALFA-tag, V5-tag, Myc-tag, hemagglutinin (HA) tag, Spot tag, T7 tag, NE tag, or green fluorescence protein (GFP), or a combination thereof. In some aspects, the polyhistidine tag consists of from about 4 to about 10 histidine residues. In some aspects, the polyhistidine tag consists of about 4, about 5, about 6, about 7, about 8, about 9, or about 10 histidine residues.

Additional examples of detectable labels and methods for introducing detectable labels into a polypeptide are known and include routine chemical, molecular biology and recombinant DNA techniques. See, e.g., Hnatowich et al., Science, 220(4597):613-615, 1983; Yao et al., Int. J. Mol. Sci., 17(2):194, 2016; Kimple et al., Curr. Protoc. Protein Sci., 73:Unit 9.9, 2013; Sambrook J, Fritsch E F. Molecular Cloning: A Laboratory Manual. Cold Spring Harbor Laboratory Press; Cold Spring Harbor, N.Y.: 1989; Molecular Cell Biology, 4th edition, Section 3.5, Purifying, Detecting and Characterizing Proteins; and Mahmoodi et al., Cogent Biology, 5(1):DOI: 10/1080/23312025.2019.1665406.

In other aspects, an antigen binding polypeptide or antigen binding polypeptide complex (e.g., an antibody or antigen binding fragment thereof) of the invention is conjugated to an agent as an antibody-drug conjugate (ADC). An ADC of the invention is useful in therapeutic, diagnostic, imaging (e.g., radioimaging), or basic research applications.

In some aspects, an antigen binding polypeptide or antigen binding polypeptide complex (e.g., an antibody or antigen binding fragment thereof) of the invention is conjugated to a cytotoxic agent, immunomodulating agent, imaging agent, or therapeutic protein, typically via a linker. The linker can comprise a cleavable unit or can be non-cleavable. Cleavable units include, for example, disulfide containing linkers that are cleavable through disulfide exchange, acid-labile linkers that are cleavable at acidic pH, and linkers that are cleavable by hydrolases, esterases, peptidases, and glucoronidases (e.g., peptide linkers and glucoronide linkers). Non-cleavable linkers are believed to release drug via a proteolytic antibody degradation mechanism.

Methods for making an ADC are known and include, but are not limited to, conjugation via thiols, amides, aldehydes, or azides, as well as other routine chemical, molecular biology and recombinant DNA techniques. See, e.g., Yao et al., Int. J. Mol. Sci., 17(2):194, 2016; Sambrook J, Fritsch E F. Molecular Cloning: A Laboratory Manual. Cold Spring Harbor Laboratory Press; Cold Spring Harbor, N.Y.: 1989; Molecular Cell Biology, 4th edition, Section 3.5, Purifying, Detecting and Characterizing Proteins; and Mahmoodi et al., Cogent Biology, 5(1):DOI: 10/1080/23312025.2019.1665406.

Modifications

In some aspects, the invention is directed to an antigen binding polypeptide or antigen binding polypeptide complex (e.g., an antibody or antigen binding fragment thereof) comprising an effector function mutation or half-life extension mutation.

Effector functions are an important part of the humoral immune response and form an link between innate and adaptive immunity. Most effector functions are induced via the Fc region of an antibody, which can interact with complement proteins and specialized Fc receptors. As used herein, an "effector function mutation," refers to a change in the amino acid sequence, typically in the Fc region, which can increase or decrease effector function, for example, increase binding affinity of Fc for specific Fc receptors, or increase antibody-dependent cellular cytotoxicity (ADCC) activity.

"Half-life" of a pharmaceutically active substance is the time it takes for the amount of the substance, once administered to the body, to reduce by half. A "half-life extension mutation" of an antigen binding polypeptide or antigen binding polypeptide complex of the invention refers to a change in the amino acid sequence, typically in the Fc region, which increases the half-life of the antigen binding polypeptide or antigen binding polypeptide complex (e.g., by increasing Fc receptor binding affinity, slowing off-rate for Fc and Fc receptors, and/or increased sialylation).

Examples of effector function mutations that increase function include, but are not limited to, the following substitutions in the Fc region, based on the EU numbering scheme: S298A/E333A/K334A, S239D/I332E, S239D/A330L/I332E, and G236A/S239D/I332E. Examples of effector function mutations that decrease function include, but are not limited to, the following substitutions in the Fc region, based on the EU numbering scheme: N297A and L234A/L235A. Additional examples of effector function mutations, half-life extension mutations and methods for incorporating the same into an amino acid sequence are known and described, for example, in Saunders, "Conceptual Approaches to Modulating Antibody Effector Functions and Circulation Half-Life," Front. Immunol. Jun. 7, 2019.

In some aspects, the invention is directed to an antigen binding polypeptide or antigen binding polypeptide complex (e.g., an antibody or antigen binding fragment thereof) comprising one or more knob-into-hole modifications.

The term "knob-into-hole modification" as used herein, refers to a genetic modification that directs the pairing of two polypeptides to promote heterodimerization. In some aspects, the modification introduces a protuberance (knob) into one polypeptide and a cavity (hole) into the other polypeptide at an interface in which the two polypeptides interact. In some aspects, a knob-into-hole modification can be created by introducing only a hole modification, for example, by replacing an amino acid residue with a smaller side chain than the original amino acid residue (e.g., a substitution of one or more serine, threonine, valine or alanine residues, or a combination thereof). In yet another aspect, a knob-into-hole modification can be created by introducing only a knob modification, for example, by replacing an amino acid residue with a larger side chain than the original amino acid residue (e.g., a substitution of one or more tryptophan or tyrosine residues, or a combination thereof).

In some aspects, the knob-into-hole modification is in the binding interface of two Fc regions, the binding interface of two CH2 regions, the binding interface of two CH3 regions, the binding interface of a CL region and a CH1 region, or the binding interface of a VH region and a VL region. See, e.g., U.S. Pub. No. 2007/0178552, Int'l Pub. No. WO 96/027011, Int'l Pub. No. WO 98/050431 and Zhu et al., Protein Science 6:781-788, 1987.

In some aspects, the antigen binding polypeptide or antigen binding polypeptide complex comprises one, two, three, four, five, six, seven, eight, nine, ten, or more knob-into-hole modifications.

Knob-into-hole modifications are well known and can be incorporated into the antigen binding polypeptides and antigen binding polypeptide complexes of the invention using routine molecular biology and recombinant DNA techniques. See, e.g., U.S. Pub. No. 2003/0078385; Int'l Pub. No. WO 96/027011; Ridgway et al., Protein Eng., 9:617-621, 1996; and Merchant et al., Nat. Biotechnol., 16:677-681, 1998.

In some aspects, the knob-into-hole modification is an amino acid substitution. As used herein, such a substitution is described based on the EU numbering scheme of Kabat, which corresponds to the numbering in the Protein Data Bank (PDB).

In some aspects, the knob-into-hole modification is a knob substitution of S354C and/or T366W, based on the EU numbering scheme.

In some aspects, the knob-into-hole modification is a hole substitution of Y349C, T366S, L368A, Y407V, L234A, L235A, P239A, M428L, N433S, M252Y, S254T, T256E, or any combination thereof, based on the EU numbering scheme.

In some aspects, the knob-into-hole modifications are hole substitutions of Y349C, T366S, L368A and Y407V, based on the EU numbering scheme. In some aspects, the knob-into-hole modifications are a hole substitutions of L234A, L235A and P239A, based on the EU numbering scheme. In some aspects, the knob-into-hole modifications are hole substitutions of L234A and L235A, based on the EU numbering scheme. In some aspects, the knob-into-hole modifications are hole substitutions of M428L and N433S, based on the EU numbering scheme. In some aspects, the knob-into-hole modifications are hole substitutions of M252Y, S254T and T256E, based on the EU numbering scheme.

In some aspects, an antigen binding polypeptide complex is an IgG1 or IgG4 antibody and the knob-into-hole modifications are knob substitutions of S354C and T366W and hole substitutions of Y349C, T366S, L368A and Y407V.

In some aspects, the antigen binding polypeptide complex is an IgG1 or IgG4 antibody and the knob-into-hole modifications are hole substitutions of L234A, L235A and P239A.

In some aspects, the antigen binding polypeptide complex is an IgG1 or IgG4 antibody and the knob-into-hole modifications are hole substitutions of L234A and L235A.

In some aspects, the antigen binding polypeptide complex is an IgG1 or IgG4 antibody and the knob-into-hole modifications are hole substitutions of M428L and N433 S.

In some aspects, the antigen binding polypeptide complex is an IgG1 or IgG4 antibody and the knob-into-hole modifications are hole substitutions of M252Y, S254T and T256E.

Chimeric Antigen Receptors

In some aspects of the invention, the antigen binding polypeptides and antigen binding polypeptide complexes can be used in chimeric antigen receptor (CAR) therapy. In some aspects, the invention is directed to a CAR comprised of an antigen binding polypeptide or antigen binding polypeptide complex of the invention. In some aspects, a CAR of the invention comprises an antigen binding polypeptide or antigen binding polypeptide complex of the invention and a transmembrane region. In some aspects, a CAR of the invention comprises an antigen binding polypeptide or antigen binding polypeptide complex of the invention, a transmembrane region, and an intracellular region. In some aspects, the intracellular region is comprised of a costimulatory region and/or an intracellular signal transduction region. In some aspects, the intracellular region is a T cell activation domain. In yet another aspect, the antigen binding polypeptide or antigen binding polypeptide complex of the invention is joined to the transmembrane region by an immunoglobulin hinge.

Polypeptides, Polynucleotides, Vectors, Cells, and Protein Production Methods

In some aspects, the invention is directed to a polypeptide encoding an antigen binding polypeptide or antigen binding polypeptide complex (e.g., an antibody or antigen binding fragment thereof) described herein.

In other aspects, the invention is directed to a polypeptide comprising an amino acid sequence of one or more of SEQ ID NOs:30-46, 94 and 96, or an amino acid sequence having at least 80%, at least 85%, at least 90%, at least 95%, at least 96%, at least 97%, at least 98%, or at least 99% identity to one or more of SEQ ID NOs:30-46, 94 and 96. For example, the polypeptide may comprise an amino acid sequence having at least 90% (such as at least 91%, 92%, 93%, 94%, 95%, 96%, 97%, 98%, or 99%) identity to one or more of SEQ ID NOs: 30-46, 94 and 96. For example, the polypeptide may comprise the amino acid sequence of one or more of SEQ ID NOs: 30-46, 94 and 96.

In other aspects, the invention is directed to a polypeptide comprising an amino acid sequence encoded by one or more of SEQ ID NOs:47-63, 95 and 97, or encoded by a polynucleotide having at least 80%, at least 85%, at least 90%, at least 95%, at least 96%, at least 97%, at least 98%, or at least 99% identity to one or more of SEQ ID NOs:47-63, 95 and 97. For example, the polypeptide may comprise an amino acid sequence encoded by a polynucleotide having at least 90% (such as at least 91%, 92%, 93%, 94%, 95%, 96%, 97%, 98%, or 99%) identity to one or more of SEQ ID NOs: 47-63, 95 and 97. For example, the polypeptide may comprise an amino acid sequence encoded by the polynucleotide shown in one or more of SEQ ID NOs: 47-63, 95 and 97.

In other aspects, the invention is directed to a polypeptide comprising an amino acid sequence of one or more of SEQ ID NOs:132-143 and 385-388, or an amino acid sequence having at least 80%, at least 85%, at least 90%, at least 95%, at least 96%, at least 97%, at least 98%, or at least 99% identity to one or more of SEQ ID NOs:132-143 and 385-388. For example, the polypeptide may comprise an amino acid sequence having at least 90% (such as at least 91%, 92%, 93%, 94%, 95%, 96%, 97%, 98%, or 99%) identity to one or more of SEQ ID NOs: 132-143 and 385-388. For example, the polypeptide may comprise the amino acid sequence of one or more of SEQ ID NOs: 132-143 and 385-388.

In other aspects, the invention is directed to a polypeptide comprising an amino acid sequence encoded by one or more of SEQ ID NOs:144-155, or encoded by a polynucleotide having at least 80%, at least 85%, at least 90%, at least 95%, at least 96%, at least 97%, at least 98%, or at least 99% identity to one or more of SEQ ID NOs:144-155. For example, the polypeptide may comprise an amino acid sequence encoded by a polynucleotide having at least 90% (such as at least 91%, 92%, 93%, 94%, 95%, 96%, 97%, 98%, or 99%) identity to one or more of SEQ ID NOs: 144-155. For example, the polypeptide may comprise an amino acid sequence encoded by the polynucleotide shown in one or more of SEQ ID NOs: 144-155.

In some aspects, the invention is directed to a polynucleotide encoding an antigen binding polypeptide or antigen binding polypeptide complex (e.g., an antibody or antigen binding fragment thereof) described herein. In other aspects, the invention is directed to a polynucleotide encoding a CAR described herein. As used herein, a "polynucleotide" includes DNA and RNA (e.g., mRNA).

In other aspects, the invention is directed to a polynucleotide comprising a polynucleotide sequence of one or more of SEQ ID NOs:47-63, 95 and 97, or a polynucleotide having at least 80%, at least 85%, at least 90%, at least 95%, at least 96%, at least 97%, at least 98%, or at least 99% identity to one or more of SEQ ID NOs:47-63, 95 and 97. For example, the polynucleotide may have at least 90% (such as at least 91%, 92%, 93%, 94%, 95%, 96%, 97%, 98%, or 99%) identity to one or more of SEQ ID NOs: 47-63, 95 and 97. For example, the polynucleotide may have the polynucleotide sequence shown in one or more of SEQ ID NOs: 47-63, 95 and 97.

In other aspects, the invention is directed to a polynucleotide encoding a polypeptide of one or more of SEQ ID NOs:30-46, 94 and 96, or a polynucleotide encoding a polypeptide having at least 80%, at least 85%, at least 90%, at least 95%, at least 96%, at least 97%, at least 98%, or at least 99% identity to one or more of SEQ ID NOs:30-46, 94 and 96. For example, the polynucleotide may encode a polypeptide having at least 90% (such as at least 91%, 92%, 93%, 94%, 95%, 96%, 97%, 98%, or 99%) identity to one or more of SEQ ID NOs:30-46, 94 and 96. For example, the polynucleotide may encode a polypeptide as shown in one or more of SEQ ID NOs: 30-46, 94 and 96.

In other aspects, the invention is directed to a polynucleotide having a sequence of one or more of SEQ ID NOs: 144-155, or a polynucleotide having at least 80%, at least 85%, at least 90%, at least 95%, at least 96%, at least 97%, at least 98%, or at least 99% identity to one or more of SEQ ID NOs:144-159. For example, the polynucleotide may have at least 90% (such as at least 91%, 92%, 93%, 94%, 95%, 96%, 97%, 98%, or 99%) identity to one or more of SEQ ID NOs: 144-159. For example, the polynucleotide may have the polynucleotide sequence shown in one or more of SEQ ID NOs: 144-159.

In other aspects, the invention is directed to a polynucleotide encoding a polypeptide of one or more of SEQ ID NOs:132-143 and 385-388, or a polynucleotide encoding a polypeptide having at least 80%, at least 85%, at least 90%, at least 95%, at least 96%, at least 97%, at least 98%, or at least 99% identity to one or more of SEQ ID NOs:132-143 and 385-388. For example, the polynucleotide may encode a polypeptide having at least 90% (such as at least 91%, 92%, 93%, 94%, 95%, 96%, 97%, 98%, or 99%) identity to one or more of SEQ ID NOs: 132-143 and 385-388. For example, the polynucleotide may encode a polypeptide as shown in one or more of SEQ ID NOs: 132-143 and 385-388.

In other aspects, the invention is directed to a vector comprising a polynucleotide described herein.

In yet other aspects, the invention is directed to a host cell comprising a polynucleotide or vector described herein.

As used herein, the term "host cell" can be any type of cell, e.g., a primary cell, a cell in culture, or a cell from a cell line. In some aspects, the term "host cell" refers to a cell containing a foreign gene [e.g., a cell subjected to gene delivery or transfected with a polynucleotide (e.g., DNA or mRNA) encoding the gene] and the progeny or potential progeny of such a cell. Progeny of such a cell may not be identical to the parent cell transfected with the nucleic acid molecule, e.g., due to mutations or environmental influences that may occur in succeeding generations or integration of the nucleic acid molecule into the host cell genome.

In other aspects, the invention is directed to an immune cell expressing a CAR of the invention or expressing a polynucleotide or vector encoding a CAR of the invention. In some aspects, the immune cell is a neutrophil, eosinophil, basophil, mast cell, monocyte, macrophage, dendritic cell, natural killer cell, or lymphocyte (B cell or T cell).

Methods which are well known to those skilled in the art can be used to construct vectors encoding antigen binding polypeptides and antigen binding polypeptide complexes (e.g., CDR, VH, VL, heavy chain and/or light chain coding sequences and appropriate transcriptional and translational control signals). These methods include, for example, in vitro recombinant DNA techniques, synthetic techniques, and in vivo genetic recombination.

A vector can be transferred to a host cell by conventional techniques and the resulting cells can then be cultured by conventional techniques to produce an antigen binding polypeptide or antigen binding polypeptide complex comprising, e.g., six CDRs, VH, VL, VH and VL, heavy chain, light chain, or heavy and light chain, or a domain thereof (e.g., one or more CDRs, VH, VL, VH and VL, heavy chain, or light chain). Thus, provided herein are host cells containing a polynucleotide encoding an antigen binding polypeptide or antigen binding polypeptide complex comprising, e.g., comprising six CDRs, VH, VL, VH and VL, heavy chain, light chain, or heavy and light chain, or a domain thereof (e.g., one or more CDRs, VH, VL, VH and VL, heavy chain, or light chain), operably linked to a promoter for expression of such sequences in the host cell. In some aspects, vectors encoding both heavy and light chains, or a domain thereof, individually, can be co-expressed in the host cell for expression. In some aspects, a host cell contains a vector comprising a polynucleotide encoding both a heavy chain and light chain, or a domain thereof. In some aspects, a host cell contains two different vectors, a first vector comprising a polynucleotide encoding a heavy chain or a domain thereof, and a second vector comprising a polynucleotide encoding a light chain or a domain thereof. In some aspects, a first host cell comprises a first vector comprising a polynucleotide encoding a heavy chain or a domain thereof, and a second host cell comprises a second vector comprising a polynucleotide encoding a light chain or a domain thereof. In some aspects, provided herein is a population of host cells comprising such a first host cell and such a second host cell.

In some aspects, provided herein is a population of vectors comprising a first vector comprising a polynucleotide encoding a light chain or domain thereof, and a second vector comprising a polynucleotide encoding a heavy chain or domain thereof. Alternatively, a single vector can be used which encodes, and is capable of expressing, both heavy and light chain polypeptides or a domain thereof.

A variety of host-vector systems can be utilized to express the polypeptides and polypeptide complexes described herein. Such host-vector systems represent vehicles by which the coding sequences of interest can be produced and subsequently purified, but also represent cells which can, when transformed or transfected with the appropriate nucleotide coding sequences, express a polypeptide or polypeptide complex described herein in situ. These include but are not limited to microorganisms such as bacteria (e.g., E. coli and B. subtilis) transformed with recombinant bacteriophage DNA, plasmid DNA or cosmid DNA expression vectors containing antibody coding sequences; yeast (e.g., Saccharomyces pichia) transformed with recombinant yeast expression vectors containing antibody coding sequences; insect cell systems infected with recombinant virus expression vectors (e.g., baculovirus) containing antibody coding sequences; plant cell systems (e.g., green algae such as Chlamydomonas reinhardtii) infected with recombinant virus expression vectors (e.g., cauliflower mosaic virus, CaMV; tobacco mosaic virus, TMV) or transformed with recombinant plasmid expression vectors (e.g., Ti plasmid) containing antibody coding sequences; or mammalian cell systems (e.g., COS (e.g., COS1 or COS), CHO, BHK, MDCK, HEK 293, NSO, PER.C6, VERO, CRL7O3O, HsS78Bst, HeLa, and NIH3T3, HEK-293T, HepG2, SP210, R1.1, B-W, L-M, BSC1, BSC40, YB/20, and BMT10 cells) harboring recombinant expression constructs containing promoters derived from the genome of mammalian cells (e.g., metallothionein promoter) or from mammalian viruses (e.g., the adenovirus late promoter; the vaccinia virus 7.5K promoter). In some aspects, cells for expressing polypeptide or polypeptide complexes described herein are CHO cells, for example CHO cells from the CHO GS System™ (Lonza). In some aspects, cells for expressing polypeptides or polypeptide complexes of the invention are human cells, e.g., human cell lines. In some aspects, a mammalian expression vector is pOptiVEC™ or pcDNA3.3. In some aspects, bacterial cells such as *Escherichia coli*, or eukaryotic cells (e.g., mammalian cells) are used for the expression of recombinant polypeptides. For example, mammalian cells such as Chinese hamster ovary (CHO) cells in conjunction with a vector such as the major intermediate early gene promoter element from human cytomegalovirus is an effective expression system for polypeptides (Foecking M K & Hofstetter H (1986) Gene 45: 101-105; and Cockett M I et al., (1990) Biotechnology 8: 662-667). In some aspects, polypeptides or polypeptide complexes described herein are produced by HEK-293T cells.

In addition, a host cell strain can be chosen which modulates the expression of the inserted sequences, or modifies and processes the gene product in the specific fashion desired. Such modifications (e.g., glycosylation) and processing (e.g., cleavage) of protein products can contribute to the function of the protein. To this end, eukaryotic host cells which possess the cellular machinery for proper processing of the primary transcript, glycosylation, and phosphorylation of the gene product can be used. Such mammalian host cells include but are not limited to CHO, VERO, BHK, Hela, MDCK, HEK 293, NIH3T3, W138, BT483, Hs578T, HTB2, BT2O and T47D, NSO (a murine myeloma cell line that does not endogenously produce any immunoglobulin chains), CRL7O3O, COS (e.g., COS1 or COS), PER.C6, VERO, HsS78Bst, HEK-293T, HepG2, SP210, R1.1, B-W, L-M, BSC1, BSC40, YB/20, BMT10 and HsS78Bst cells.

Once a polypeptide or polypeptide complex described herein has been produced by recombinant expression, it can be purified by any method known in the art for purification of a protein or immunoglobulin molecule, for example, by chromatography (e.g., ion exchange, affinity, particularly by affinity for the specific antigen after Protein A, and size exclusion chromatography), centrifugation, differential solubility, or by any other standard technique for the purification of proteins. Further, the polypeptides or polypeptide complexes described herein can be fused to heterologous polypeptide sequences described herein (e.g., tags) or otherwise known in the art to facilitate purification.

In some aspects, a polypeptide or polypeptide complex described herein is isolated or purified. Generally, an isolated polypeptide or polypeptide complex is one that is substantially free of other polypeptides or polypeptide complexes with different antigenic specificities. For example, in some aspects, a preparation of a polypeptide or polypeptide complex described herein is substantially free of cellular material and/or chemical precursors.

Pharmaceutical Compositions and Kits

In some aspects, the invention is directed to a pharmaceutical composition comprising an antigen binding polypeptide, antigen binding polypeptide complex (e.g., antibody or antigen binding fragment thereof), polypeptide, polynucleotide, vector, CAR or cell described herein.

In some aspects, the invention is directed to a pharmaceutical composition comprising (1) an antigen binding polypeptide, antigen binding polypeptide complex (e.g., antibody or antigen binding fragment thereof), polynucleotide, vector, CAR or cell described herein, and (2) a pharmaceutically acceptable carrier. The term "pharmaceutically acceptable carrier" includes any and all solvents, co-solvents, complexing agents, dispersion media, coatings, antibacterial and antifungal agents, isotonic and absorption delaying agents, and the like, which are not biologically or otherwise undesirable. The use of such media and agents for pharmaceutically active substances is known in the art.

Except insofar as any conventional media or agent is incompatible with the active ingredient, its use in the therapeutic formulations is contemplated. Supplementary active ingredients can also be incorporated into the pharmaceutical compositions of the invention. In addition, various excipients, such as are commonly used in the art, can be included. These and other such compounds are described in the literature, e.g., in the Merck Index, Merck & Company, Rahway, NJ. Considerations for the inclusion of various components in pharmaceutical compositions are described, e.g., in Gilman et al. (Eds.) (2010); Goodman and Gilman's: The Pharmacological Basis of Therapeutics, 12th Ed., The McGraw-Hill Companies. In some aspects, the pharmaceutical composition is for parenteral, intravenous or subcutaneous administration.

In other aspects, the invention is directed to a kit comprising an antigen binding polypeptide, antigen binding polypeptide complex (e.g., antibody or antigen binding fragment thereof), polypeptide, polynucleotide, vector, cell, CAR or pharmaceutical composition described herein, or a combination thereof. Once a pharmaceutical composition has been formulated, it can be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration. In some aspects, the invention provides kits for producing a single-dose administration unit. In some aspects, the kits of the invention can contain both a first container having a dried protein and a second container having an aqueous formulation. In some aspects, kits containing single and multi-chambered pre-filled syringes (e.g., liquid syringes and lyosyringes) are also provided. In some aspects, the kit contains components for intravenous or subcutaneous administration.

Methods of Use

In some aspects, the invention is directed to certain methods of use of an antigen binding polypeptide, antigen binding polypeptide complex (e.g., an antibody or antigen binding fragment thereof), polypeptide, polynucleotide, vector, cell, CAR or pharmaceutical composition described herein, or a combination thereof. Any of the antigen binding polypeptide structures and any of the antigen binding polypeptide complex structures described herein targeting one or more of the targets described herein may be used in any of the methods and uses of the invention.

In some aspects, the antigen binding polypeptides or antigen binding polypeptide complexes (e.g., antibodies or antigen binding fragments thereof) specifically binds to one or more of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. As described herein, the VL1, VL2, VL3, VL4, VL5, VL6, VH1, VH2, VH3, VH4, VH5 and/or VH6 of the antigen binding polypeptide or polypeptide comprised within the antigen binding polypeptide complex may specifically bind to one or more of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 or CD16A. For example, the antigen binding polypeptide or antigen binding polypeptide complex (e.g., antibodies or antigen binding fragments thereof) may specifically bind to CD3, CD28, CD38 and CD19. For example, the antigen binding polypeptide or antigen binding polypeptide complex (e.g., antibodies or antigen binding fragments thereof) may specifically bind to CD3, CD28, Trop2 and cMet. For example, the antigen binding polypeptide or antigen binding polypeptide complex (e.g., antibodies or antigen binding fragments thereof) may specifically bind to CD3, CD28, CD19 and CD20. Any of the antigen binding polypeptide structures and any of the antigen binding polypeptide complex structures described herein may be used to target one or more of the targets described herein in the methods and uses of the invention.

CD3 (Cluster of Differentiation 3) is a protein complex and T cell co-receptor that is involved in activating both the cytotoxic T cell (CD8+ naive T cells) and T helper cells (CD4+ naive T cells).

CD19 (Cluster of Differentiation 19, also known as B-Lymphocyte Surface Antigen B4, T Cell Surface Antigen Leu-12 and CVID3) is a transmembrane protein expressed in all B lineage cells. CD19 plays two major roles in human B cells: on the one hand, it acts as an adaptor protein to recruit cytoplasmic signaling proteins to the membrane; on the other, it works within the CD19/CD21 complex to decrease the threshold for B cell receptor signaling pathways. Due to its presence on all B cells, it is a biomarker for B lymphocyte development, lymphoma diagnosis and can be utilized as a target for leukemia immunotherapies.

CD28 (Cluster of Differentiation 28) is one of the proteins expressed on T cells that provide costimulatory signals required for T cell activation and survival. T cell stimulation through CD28 in addition to the T Cell Receptor (TCR) can provide a potent signal for the production of various interleukins (IL-6 in particular).

CD38 (Cluster of Differentiation 38, also known as cyclic ADP ribose hydrolase) is a glycoprotein found on the surface of many immune cells (white blood cells), including CD4+, CD8+, B lymphocytes and natural killer cells. CD38 also functions in cell adhesion, signal transduction and calcium signaling.

Her2 (Human Epidermal Growth Factor Receptor 2, also known as Her2/neu, Erb-B2, or CD340) is a member of the human epidermal growth factor receptor family. Amplification or overexpression of Her2 has been shown to play an important role in the development and progression of certain types of breast cancer.

cMet, also called membrane tyrosine-protein kinase Met or hepatocyte growth factor receptor (HGFR), is a protein that in humans is encoded by the MET gene. MET is a single pass tyrosine kinase receptor essential for embryonic development, organogenesis and wound healing. Abnormal MET activation in cancer correlates with poor prognosis, where aberrantly active MET triggers tumor growth, formation of new blood vessels (angiogenesis) that supply the tumor with nutrients, and cancer spread to other organs (metastasis).

Tumor-associated calcium signal transducer 2 is also known as Trop2 and epithelial glycoprotein-1 antigen (EGP-1). It is a protein that in humans is encoded by the TACSTD2 gene. Trop2 plays a role in tumor progression by actively interacting with several key molecular signaling pathways traditionally associated with cancer development and progression. Aberrant overexpression of Trop-2 has been described in several solid cancers, such as colorectal, renal, lung, and breast cancers. Trop-2 expression has also been described in some rare and aggressive malignancies, e.g., salivary duct, anaplastic thyroid, uterine/ovarian, and neuroendocrine prostate cancers.

B-lymphocyte antigen CD20 (CD20) is expressed on the surface of B cells beginning at the pro-B phase and progressively increasing in concentration until maturity. In humans CD20 is encoded by the MS4A1 gene. This gene encodes a member of the membrane-spanning 4A gene family. It is found on B cell lymphomas, hairy cell leukemia, B cell chronic lymphocytic leukemia, and melanoma cancer stem cells.

Receptor tyrosine-protein kinase erbB-3, also known as Her3 (human epidermal growth factor receptor 3), is a membrane bound protein that in humans is encoded by the ERBB3 gene. ErbB3 is a member of the epidermal growth factor receptor (EGFR/ERBB) family of receptor tyrosine kinases ErbB3 as a heterodimerization partner, most critically with ErbB2, is implicated in growth, proliferation, chemotherapeutic resistance, and the promotion of invasion and metastasis. ErbB3 is associated with targeted therapeutic resistance in numerous cancers.

The adenosine A2A receptor, also known as A2AR or ADORA2A, is an adenosine receptor. This protein is a member of the G protein-coupled receptor (GPCR) family which possess seven transmembrane alpha helices, as well as an extracellular N-terminus and an intracellular C-terminus.

A proliferation-inducing ligand (APRIL), also known as tumor necrosis factor ligand superfamily member 13

(TNFSF13), is a protein of the TNF superfamily recognized by the cell surface receptor TACI. It is a member of the tumor necrosis factor ligand (TNF) ligand family. This protein is a ligand for TNFRSF17/BCMA, a member of the TNF receptor family. This protein and its receptor are both found to be important for B cell development.

The epidermal growth factor receptor (EGFR; ErbB-1; HER1 in humans) is a transmembrane protein that is a receptor for members of the epidermal growth factor family (EGF family) of extracellular protein ligands. The epidermal growth factor receptor is a member of the ErbB family of receptors, a subfamily of four closely related receptor tyrosine kinases. EGFR (ErbB-1), HER2/neu (ErbB-2), Her 3 (ErbB-3) and Her 4 (ErbB-4). In many cancer types, mutations affecting EGFR expression or activity could result in cancer.

Fibroblast growth factor receptor (FGFR) is a receptor that binds to members of the fibroblast growth factor (FGF) family of proteins. The FGF/FGFR signalling pathway is involved in a variety of cancers.

B-cell activating factor (BAFF), also known as tumor necrosis factor ligand superfamily member 13B, is a protein that in humans is encoded by the TNFSF13B gene. BAFF is also known as B Lymphocyte Stimulator (BLyS) and TNF- and APOL-related leukocyte expressed ligand (TALL-1) and the Dendritic cell-derived TNF-like molecule (CD257 antigen; cluster of differentiation 257). BAFF is a cytokine that belongs to the tumor necrosis factor (TNF) ligand family. This cytokine is a ligand for receptors TNFRSF13B/TACI, TNFRSF17/BCMA, and TNFRSF13C/BAFF-R. This cytokine is expressed in B cell lineage cells, and acts as a potent B cell activator. It has been also shown to play an important role in the proliferation and differentiation.

BAFF receptor (B-cell activating factor receptor, BAFF-R), also known as tumor necrosis factor receptor superfamily member 13C (TNFRSF13C) and BLyS receptor 3 (BR3), is a membrane protein of the TNF receptor superfamily which recognizes BAFF, an essential factor for B cell maturation and survival. In humans it is encoded by the TNFRSF13C gene. BAFF enhances B-cell survival in vitro and is a regulator of the peripheral B-cell population.

B-cell maturation antigen (BCMA or BCM), also known as tumor necrosis factor receptor superfamily member 17 (TNFRSF17), is a protein that in humans is encoded by the TNFRSF17 gene. TNFRSF17 is a cell surface receptor of the TNF receptor superfamily which recognizes BAFF. Serum B-cell maturation antigen (sBCMA) is the cleaved form of BCMA, found at low levels in the serum of normal patients and generally elevated in patients with multiple myeloma (MM).

Bruton's tyrosine kinase (BTK), also known as tyrosine-protein kinase BTK, is a tyrosine kinase that is encoded by the BTK gene in humans BTK plays a crucial role in B cell development as it is required for transmitting signals from the pre-B cell receptor that forms after successful immunoglobulin heavy chain rearrangement. It also has a role in mast cell activation through the high-affinity IgE receptor.

B- and T-lymphocyte attenuator or BTLA (also known as cluster of differentiation 272 or CD272) is a protein that belongs to the CD28 immunoglobulin superfamily (IgSF) which is encoded by the BTLA gene. Its discovered ligand herpes virus entry mediator or HVEM (also known as tumour necrosis factor receptor superfamily member 14 or TNFRSF14) belongs to the tumor necrosis factor receptor superfamily (TNFRSF). In many cases BTLA expression is connected with unfavourable outcomes as it, for instance, inhibits the function of human CD8+ cancer-specific T cells.

Programmed cell death 1 ligand 2 (also known as PDL2 or B7DC) is a protein that in humans is encoded by the PDCD1LG2 gene. PDCD1LG2 has also been designated as CD273 (cluster of differentiation 273). PDCD1LG2 is an immune checkpoint receptor ligand which plays a role in negative regulation of the adaptive immune response. PD-L2 is one of two known ligands for Programmed cell death protein 1 (PD-1). PD-L2, PD-L1, and PD-1 expressions are important in the immune response to certain cancers.

Programmed death-ligand 1 (PD-L1) also known as cluster of differentiation 274 (CD274) or B7 homolog 1 (B7-H1) is a protein that in humans is encoded by the CD274 gene. It is a 40 kDa type 1 transmembrane protein that has been speculated to play a major role in suppressing the adaptive arm of immune systems during particular events. The binding of PD-L1 to the inhibitory checkpoint molecule PD-1 transmits an inhibitory signal based on interaction with phosphatases (SHP-1 or SHP-2) via Immunoreceptor Tyrosine-Based Switch Motif (ITSM). This reduces the proliferation of antigen-specific T-cells in lymph nodes, while simultaneously reducing apoptosis in regulatory T cells (anti-inflammatory, suppressive T cells)—further mediated by a lower regulation of the gene Bcl-2. Upregulation of PD-L1 may allow cancers to evade the host immune system.

V-set domain-containing T-cell activation inhibitor 1 (also known as B7H4) is a protein that in humans is encoded by the VTCN1 gene. B7H4 belongs to the B7 family of costimulatory proteins. These proteins are expressed on the surface of antigen-presenting cells and interact with ligands (e g, CD28; MIM 186760) on T lymphocytes. B7H4 is an immune checkpoint molecule.

Delta-like 3 (Drosophila), also known as DLL3, is a protein which in humans is encoded by the DLL3 gene.

Ectonucleoside triphosphate diphosphohydrolase-1 (gene: ENTPD1; protein: NTPDase1), also known as CD39 (Cluster of Differentiation 39), is a typical cell surface enzyme with a catalytic site on the extracellular face. NTPDase1 is an ectonucleotidase that catalyse the hydrolysis of γ- and β-phosphate residues of triphospho- and diphosphonucleosides to the monophosphonucleoside derivative. NTPDase1 hydrolyzes P2 receptor ligands, namely ATP, ADP, UTP and UDP with similar efficacy. NTPDase1 can therefore affect P2 receptor activation and functions.

Fc fragment of IgE, high affinity I, receptor for; alpha polypeptide, also known as FCER1A, is a protein which in humans is encoded by the FCER1A gene. The high affinity IgE receptor plays a central role in allergic disease, coupling allergen and mast cell to initiate the inflammatory and immediate hypersensitivity responses that are characteristic of disorders such as hay fever and asthma.

The high-affinity IgE receptor, also known as FCER1, or Fc epsilon RI, is the high-affinity receptor for the Fc region of immunoglobulin E, an antibody isotype involved in the allergy disorder and parasites immunity FCER1 is a tetrameric receptor complex that binds Fc portion of the E heavy chain of IgE. It is constitutively expressed on mast cells and basophils and is inducible in eosinophils.

Arachidonate 5-lipoxygenase-activating protein also known as 5-lipoxygenase activating protein, or FLAP, is a protein that in humans is encoded by the ALOX5AP gene. FLAP is necessary for the activation of 5-lipoxygenase and therefore for the production of leukotrienes, 5-hydroxyeicosatetraenoic acid, 5-oxo-eicosatetraenoic acid, and specialized pro-resolving mediators of the lipoxin and resolvin classes. Leukotrienes, which need the FLAP protein to be made, have an established pathological role in allergic and respiratory diseases.

Glutamate carboxypeptidase II (GCPII), also known as N-acetyl-L-aspartyl-L-glutamate peptidase I (NAALADase I), NAAG peptidase, or prostate-specific membrane antigen (PSMA) is an enzyme that in humans is encoded by the FOLH1 (folate hydrolase 1) gene. Human GCPII contains 750 amino acids and weighs approximately 84 kDa. Human FOLH1 is highly expressed in the prostate, roughly a hundred times greater than in most other tissues. In some prostate cancers, PSMA is the second-most upregulated gene product, with an 8- to 12-fold increase over levels in noncancerous prostate cells. In vitro studies using prostate and breast cancer cell lines with decreased FOLH1 levels showed a significant decrease in the proliferation, migration, invasion, adhesion and survival of the cells.

Mucin 1, cell surface associated (MUC1), also called polymorphic epithelial mucin (PEM) or epithelial membrane antigen or EMA, is a mucin encoded by the MUC1 gene in humans. The ability of chemotherapeutic drugs to access the cancer cells is inhibited by the heavy glycosylation in the extracellular domain of MUC1.

CD133 antigen, also known as prominin-1, is a glycoprotein that in humans is encoded by the PROM1 gene. It is a member of pentaspan transmembrane glycoproteins, which specifically localize to cellular protrusions. CD133 is expressed in hematopoietic stem cells, endothelial progenitor cells, glioblastoma, neuronal and glial stem cells, various pediatric brain tumors, as well as adult kidney, mammary glands, trachea, salivary glands, uterus, placenta, digestive tract, testes, and some other cell types.

Mucin-16 (MUC-16), also known as Ovarian cancer-related tumor marker CA125, is a protein that in humans is encoded by the MUC16 gene. MUC-16 is a member of the mucin family glycoproteins. MUC-16 has found application as a tumor marker or biomarker that may be elevated in the blood of some patients with specific types of cancers, most notably ovarian cancer, or other conditions that are benign.

Lysosomal-associated membrane protein 1 (LAMP1) also known as lysosome-associated membrane glycoprotein 1 and CD107a (Cluster of Differentiation 107a), is a protein that in humans is encoded by the LAMP1 gene. LAMP1 is a type I transmembrane protein which is expressed at high or medium levels in many different normal tissue cell types. It resides primarily across lysosomal membranes, and functions to provide selectins with carbohydrate ligands LAMP1 has also been shown to be a marker of degranulation on lymphocytes such as CD8+ and NK cells and may also play a role in tumor cell differentiation and metastasis.

Programmed death-ligand 1 (PD-L1), also known as cluster of differentiation 274 (CD274) or B7 homolog 1 (B7-H1), is a protein that in humans is encoded by the CD274 gene. Upregulation of PD-L1 may allow cancers to evade the host immune system.

Carcinoembryonic antigen-related cell adhesion molecule 1 (biliary glycoprotein) (CEACAM1), also known as CD66a (Cluster of Differentiation 66a), is a human glycoprotein, and a member of the carcinoembryonic antigen (CEA) gene family.

Metalloreductase STEAP1 is an enzyme that in humans is encoded by the STEAP1 gene. This gene is predominantly expressed in prostate tissue, and is found to be upregulated in multiple cancer cell lines. The gene product is predicted to be a six-transmembrane protein, and was shown to be a cell surface antigen significantly expressed at cell-cell junctions.

Epithelial cell adhesion molecule (EpCAM) is a transmembrane glycoprotein mediating calcium-independent homotypic cell-cell adhesion in epithelia. EpCAM is also involved in cell signaling, migration, proliferation, and differentiation Additionally, EpCAM has oncogenic potential via its capacity to upregulate c-myc, e-fabp, and cyclins A & E. Since EpCAM is expressed exclusively in epithelia and epithelial-derived neoplasms, EpCAM can be used as diagnostic marker for various cancers.

In some aspects, the antigen binding polypeptides or antigen binding polypeptide complexes (e.g., antibodies or antigen binding fragments thereof) specifically bind a viral peptide, protein, polypeptide, or a fragment thereof. In some aspects, the viral peptide, protein, polypeptide, or a fragment thereof is selected from influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, and glycoprotein E1E2 of human hepatitis C virus. As described herein, the VL1, VL2, VL3, VL4, VL5, VL6, VH1, VH2, VH3, VH4, VH5 and/or VH6 of the antigen binding polypeptide or polypeptide comprised within the antigen binding polypeptide complex may specifically bind to one or more viral peptide, protein, polypeptide, or a fragment thereof such as an influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, glycoprotein E1E2 of human hepatitis C virus or a combination thereof. Any of the antigen binding polypeptide structures and any of the antigen binding polypeptide complex structures described herein may be used to target one or more of the viral targets described herein in the methods and uses of the invention.

Accordingly, In some aspects, the invention is directed to a method of modulating T cell activation, comprising administering to a subject in need thereof an antigen binding polypeptide, antigen binding polypeptide complex (e.g., antibody or antigen binding fragment thereof), polypeptide, polynucleotide, vector, host cell or pharmaceutical composition described herein, or a combination thereof. In some aspects, the invention is directed to a method of modulating T cell activation, comprising administering to a subject in need thereof a therapeutically effective amount of an antigen binding polypeptide, antigen binding polypeptide complex (e.g., antibody or antigen binding fragment thereof), polypeptide, polynucleotide, vector, host cell or pharmaceutical composition described herein, or a combination thereof.

In some aspects, the invention is directed to a method of modulating cell proliferation, comprising administering to a subject in need thereof an antigen binding polypeptide, antigen binding polypeptide complex (e.g., antibody or antigen binding fragment thereof), polypeptide, polynucleotide, vector, cell, CAR or pharmaceutical composition described herein, or a combination thereof. In some aspects, the invention is directed to a method of modulating cell proliferation, comprising administering to a subject in need thereof a therapeutically effective amount of an antigen binding polypeptide, antigen binding polypeptide complex (e.g., antibody or antigen binding fragment thereof), polypeptide, polynucleotide, vector, cell, CAR or pharmaceutical composition described herein, or a combination thereof.

As used herein, the term "modulating" means an increase or decrease in a given property. For example, "modulating T cell activation" means an increase or decrease in T cell activation and "modulating cell proliferation means an increase or decrease in cell proliferation.

As used herein, the term "subject" means a human or a non-human mammal, e g, a dog, a cat, a mouse, a rat, a cow, a sheep, a pig, a goat, a non-human primate or a bird, e.g., a chicken, as well as any other vertebrate or invertebrate. In some aspects, the subject is a human. In some aspects, the subject is a veterinary animal. In some aspects, the subject is a mammal.

As used herein, the terms "treat" or "treatment" refer to therapeutic or palliative measures. Beneficial or desired clinical results include, but are not limited to, alleviation, in whole or in part, of symptoms associated with a disease or disorder or condition, diminishment of the extent of disease, stabilized (i.e., not worsening) state of disease, delay or slowing of disease progression, amelioration or palliation of the disease state (e.g., one or more symptoms of the disease), and remission (whether partial or total), whether detectable or undetectable. "Treatment" can also mean prolonging survival as compared to expected survival if not receiving treatment.

As used herein, the terms "prevent" or "preventing" refer to the prevention of the onset, recurrence or spread, in whole or in part, of a disease or condition described herein, or a symptom thereof.

As used herein, a "therapeutically effective amount" is an amount of an antigen binding polypeptide or antigen binding polypeptide complex (e.g., an antibody or antigen binding fragment thereof) that is sufficient to achieve the desired effect and can vary according to the nature and severity of the disease condition, and the potency of the polypeptide or polypeptide complex. In some aspects, an antigen binding polypeptide or antigen binding polypeptide complex of the invention can be delivered by administering a polynucleotide, vector, CAR or cell that encodes the antigen binding polypeptide or antigen binding polypeptide complex. In some aspects, an antigen binding polypeptide or antigen binding polypeptide complex thereof can be delivered by administering a pharmaceutical composition containing the polypeptide or polypeptide complex. A therapeutic effect is the relief, to some extent, of one or more of the symptoms of the disease, and can include curing a disease. "Curing" means that the symptoms of active disease are eliminated. However, certain long-term or permanent effects of the disease can exist even after a cure is obtained.

T cell activation can be measured using scientific methods that are well known in the art. For example, T cell activation can be determined by detecting activation of T cells in response to a stimulus by measuring a characteristic response, such as cytokine secretion, or by analyzing cells by the specificity of their T cell receptor. Specific techniques include, but are not limited to, limiting dilutions culture, ELISPOT (enzyme-linked immunospot), intracellular staining, cytokine capture, tetramer staining, and spectratyping and biosensor assays.

Cell proliferation can be measured using scientific methods that are well known in the art. Such methods include, but are not limited to, metabolic activity assays (e.g., measuring absorbance of formazan dye), cell proliferation marker assays (e.g., Ki-68 antibody), ATP concentration assays (e.g., luciferase luminescence), and DNA synthesis assays (e.g., $^3$H-thymine or bromodeoxyuridine (BrdU)).

In some aspects, the invention is directed to a method of neutralizing viral infection, comprising administering to a subject in need thereof an antigen binding polypeptide, antigen binding polypeptide complex (e.g., antibody or antigen binding fragment thereof), polypeptide, polynucleotide, vector, CAR, cell or pharmaceutical composition described herein, or a combination thereof. In some aspects, the invention is directed to a method of neutralizing viral infection, comprising administering to a subject in need thereof a therapeutically effective amount of an antigen binding polypeptide, antigen binding polypeptide complex (e.g., antibody or antigen binding fragment thereof), polypeptide, polynucleotide, vector, CAR, cell or pharmaceutical composition described herein, or a combination thereof. In some aspects, the viral infection is not human immunodeficiency virus (HIV) and/or severe acute respiratory syndrome (SARS).

In some aspects, the invention is directed to a method of treating or preventing a disease or condition, comprising administering to a subject in need thereof an antigen binding polypeptide, antigen binding polypeptide complex (e.g., antibody or antigen binding fragment thereof), polypeptide, polynucleotide, vector, cell, CAR or pharmaceutical composition described herein, or a combination thereof. In some aspects, the invention is directed to a method of treating or preventing a disease or condition, comprising administering to a subject in need thereof a therapeutically effective amount of an antigen binding polypeptide, antigen binding polypeptide complex (e.g., antibody or antigen binding fragment thereof), polypeptide, polynucleotide, vector, cell, CAR or pharmaceutical composition described herein, or a combination thereof. The present invention further provides an antigen binding polypeptide, antigen binding polypeptide complex (e.g., antibody or antigen binding fragment thereof), polypeptide, polynucleotide, vector, cell, CAR or pharmaceutical composition described herein, or a combination thereof, for use in treating or preventing a disease or condition in a subject. The present invention further provides the use of an antigen binding polypeptide, antigen binding polypeptide complex (e.g., antibody or antigen binding fragment thereof), polypeptide, polynucleotide, vector, cell, CAR or pharmaceutical composition described herein, or a combination thereof in the manufacture of a medicament for the treatment or prevention of a disease or condition in a subject.

In some aspects, the invention is directed to a method of treating or preventing a virus infection, wherein the virus is influenza virus, respiratory syncytial virus (RSV), chlamydia, adenovirdiae, mastadeno virus, aviadenovirus, herpesviridae, herpes simplex virus 1, herpes simplex virus 2, herpes simplex virus 5, herpes simplex virus 6, leviviridae, levivirus, enterobacteria phase MS2, allolevirus, poxviridae, chordopoxvirinae, parapoxvirus, avipoxvirus, capripoxvirus, leporiipoxvirus, suipoxvirus, molluscipoxvirus, entomopoxvirinae, papovaviridae, polyomavirus, papillomavirus, paramyxoviridae, paramyxovirus, parainfluenza virus 1, mobillivirus, measles virus, rubulavirus, mumps virus, pneumonovirinae, pneumovirus, me tapneumo virus, avian pneumovirus, human metapneumovirus, picornaviridae, enterovirus, rhinovirus, hepatovirus, human hepatitis A virus, cardiovirus, andaptho virus, reoviridae, orthoreovirus, orbivirus, rotavirus, cypovirus, fijivirus, phytoreovirus, oryzavirus, retroviridae, mammalian type B retroviruses, mammalian type C retroviruses, avian type C retroviruses, type D retrovirus group, BLV-HTLV retroviruses, lentivirus, human immunodeficiency virus 1, human immunodeficiency virus 2, HTLV-I and -II viruses, SARS coronavirus, herpes simplex E virus, Epstein Barr virus, cytomegalovirus, hepatitis virus (HCV, HAV, HBV, HDV, HEV), Toxoplasma gondii virus, treponema pallidium virus, human T-lymphotrophic virus, encephalitis virus, West Nile virus, Dengue virus, Varicella Zoster Virus, rubeola, mumps, rubella, spumavirus, flaviviridae, hepatitis C virus, hepadnaviridae, hepatitis B virus, togaviridae, alphavirus sindbis virus, rubivirus, rubella virus, rhabdoviridae, vesiculovirus, lyssavirus, ephemerovirus, cytorhabdo virus, necleorhabdo virus, arenaviridae, arenavirus, lymphocytic choriomeningitis virus, Ippy virus, lassa virus, coronaviridae, coronavirus or torovirus. The present invention further provides an antigen binding polypeptide, antigen binding polypeptide complex (e.g., antibody or antigen binding fragment thereof), polypeptide, polynucleotide, vector, cell, CAR or pharmaceutical composition described herein, or a combination thereof, for use in treating or preventing a virus infection in a subject. The present invention further provides the use of an antigen binding polypeptide, antigen binding polypeptide complex (e.g., antibody or antigen binding fragment thereof), polypeptide, polynucleotide, vector, cell, CAR or pharmaceutical composition described herein, or a combination thereof in the manufacture of a medicament for the treatment or prevention of a virus infection in a subject. The virus may be selected from: influenza virus, respiratory syncytial virus (RSV), chlamydia, adenovirdiae, mastadeno virus, aviadenovirus, herpesviridae, herpes simplex virus 1, herpes simplex virus 2, herpes simplex virus 5, herpes simplex virus 6, leviviridae, levivirus, enterobacteria phase MS2, allolevirus, poxviridae, chordopoxvirinae, parapoxvirus, avipoxvirus, capripoxvirus, leporiipoxvirus, suipoxvirus, molluscipoxvirus, entomopoxvirinae, papovaviridae, polyomavirus, papillomavirus, paramyxoviridae, paramyxovirus, parainfluenza virus 1, mobillivirus, measles virus, rubulavirus, mumps virus, pneumonovirinae, pneumovirus, me tapneumo virus, avian pneumovirus, human metapneumovirus, picornaviridae, enterovirus, rhinovirus, hepatovirus, human hepatitis A virus, cardiovirus, andaptho virus, reoviridae, orthoreovirus, orbivirus, rotavirus, cypovirus, fijivirus, phytoreovirus, oryzavirus, retroviridae, mammalian type B retroviruses, mammalian type C retroviruses, avian type C retroviruses, type D retrovirus group, BLV-HTLV retroviruses, lentivirus, human immunodeficiency virus 1, human immunodeficiency virus 2, HTLV-I and -II viruses, SARS coronavirus, herpes simplex E virus, Epstein Barr virus, cytomegalovirus, hepatitis virus (HCV, HAV, HBV, HDV, HEV), Toxoplasma gondii virus, treponema pallidium virus, human T-lymphotrophic virus, encephalitis virus, West Nile virus, Dengue virus, Varicella Zoster Virus, rubeola, mumps, rubella, spumavirus, flaviviridae, hepatitis C virus, hepadnaviridae, hepatitis B virus, togaviridae, alphavirus sindbis virus, rubivirus, rubella virus, rhabdoviridae, vesiculovirus, lyssavirus, ephemerovirus, cytorhabdo virus, necleorhabdo virus, arenaviridae, arenavirus, lymphocytic choriomeningitis virus, Ippy virus, lassa virus, coronaviridae, coronavirus and torovirus.

In some aspects, the invention is directed to a method of treating or preventing a cancer, comprising administering to a subject in need thereof an antigen binding polypeptide, antigen binding polypeptide complex (e.g., antibody or antigen binding fragment thereof), polypeptide, polynucleotide, vector, cell, CAR or pharmaceutical composition described herein, or a combination thereof. In some aspects, the invention is directed to a method of treating or preventing a cancer, comprising administering to a subject in need thereof a therapeutically effective amount of an antigen binding polypeptide, antigen binding polypeptide complex (e.g., antibody or antigen binding fragment thereof), polypeptide, polynucleotide, vector, cell, CAR or pharmaceutical composition described herein, or a combination thereof. The present invention further provides an antigen binding polypeptide, antigen binding polypeptide complex (e.g., antibody or antigen binding fragment thereof), polypeptide, polynucleotide, vector, cell, CAR or pharmaceutical composition described herein, or a combination thereof, for use in treating or preventing a cancer in a subject. The present invention further provides the use of an antigen binding polypeptide, antigen binding polypeptide complex (e.g., antibody or antigen binding fragment thereof), polypeptide, polynucleotide, vector, cell, CAR or pharmaceutical composition described herein, or a combination thereof in the manufacture of a medicament for the treatment or prevention of a cancer in a subject.

In some aspects, the invention is directed to a method of neutralizing HIV infection, comprising administering to a subject in need thereof an antigen binding polypeptide, antigen binding polypeptide complex (e.g., antibody or antigen binding fragment thereof), polypeptide, polynucleotide, vector, CAR, cell or pharmaceutical composition described herein, or a combination thereof. In some aspects, the invention is directed to a method of neutralizing HIV infection, comprising administering to a subject in need thereof a therapeutically effective amount of an antigen binding polypeptide, antigen binding polypeptide complex (e.g., antibody or antigen binding fragment thereof), polypeptide, polynucleotide, vector, CAR, cell or pharmaceutical composition described herein, or a combination thereof.

In some aspects, the invention is directed to a method of treating or preventing HIV infection, comprising administering to a subject in need thereof an antigen binding polypeptide, antigen binding polypeptide complex (e.g., antibody or antigen binding fragment thereof), polypeptide, polynucleotide, vector, CAR, cell or pharmaceutical composition described herein, or a combination thereof. In some aspects, the invention is directed to a method of treating or preventing HIV infection, comprising administering to a subject in need thereof a therapeutically effective amount of an antigen binding polypeptide, antigen binding polypeptide complex (e.g., antibody or antigen binding fragment thereof), polypeptide, polynucleotide, vector, CAR, cell or pharmaceutical composition described herein, or a combination thereof. The present invention further provides an antigen binding polypeptide, antigen binding polypeptide complex (e.g., antibody or antigen binding fragment thereof), polypeptide, polynucleotide, vector, cell, CAR or pharmaceutical composition described herein, or a combination thereof, for use in treating or preventing HIV infection in a subject. The present invention further provides the use of an antigen binding polypeptide, antigen binding polypeptide complex (e.g., antibody or antigen binding fragment thereof), polypeptide, polynucleotide, vector, cell, CAR or pharmaceutical composition described herein, or a combination thereof in the manufacture of a medicament for the treatment or prevention of HIV infection in a subject.

In some aspects, the invention is directed to a method of treating or preventing acquired immunodeficiency syndrome (AIDS), comprising administering to a subject in need thereof an antigen binding polypeptide, antigen binding polypeptide complex (e.g., antibody or antigen binding fragment thereof), polypeptide, polynucleotide, vector, CAR, cell or pharmaceutical composition described herein, or a combination thereof. In some aspects, the invention is directed to a method of treating or preventing AIDS, comprising administering to a subject in need thereof a therapeutically effective amount of an antigen binding polypeptide, antigen binding polypeptide complex (e.g., antibody or antigen binding fragment thereof), polypeptide, polynucleotide, vector, CAR, cell or pharmaceutical composition described herein, or a combination thereof. The present invention further provides an antigen binding polypeptide, antigen binding polypeptide complex (e.g., antibody or antigen binding fragment thereof), polypeptide, polynucleotide, vector, cell, CAR or pharmaceutical composition described herein, or a combination thereof, for use in treating or preventing AIDS in a subject. The present invention further provides the use of an antigen binding polypeptide, antigen binding polypeptide complex (e.g., antibody or antigen binding fragment thereof), polypeptide, polynucleotide, vector, cell, CAR or pharmaceutical composition described herein, or a combination thereof in the manufacture of a medicament for the treatment or prevention of AIDS in a subject.

AIDS-related complex (ARC) is prodromal phase of HIV infection that presents certain symptoms that include, but are not limited to, low grade fever, unexplained weight loss, diarrhea, HIV-related opportunistic infections and generalized lymphadenopathy. In some aspects, the invention is directed to a method of treating or preventing ARC, comprising administering to a subject in need thereof an antigen binding polypeptide, antigen binding polypeptide complex (e.g., antibody or antigen binding fragment thereof), polypeptide, polynucleotide, vector, CAR, cell or pharmaceutical composition described herein, or a combination thereof. In some aspects, the invention is directed to a method of treating or preventing ARC, comprising administering to a subject in need thereof a therapeutically effective amount of an antigen binding polypeptide, antigen binding polypeptide complex (e.g., antibody or antigen binding fragment thereof), polypeptide, polynucleotide, vector, CAR, cell or pharmaceutical composition described herein, or a combination thereof. The present invention further provides an antigen binding polypeptide, antigen binding polypeptide complex (e.g., antibody or antigen binding fragment thereof), polypeptide, polynucleotide, vector, cell, CAR or pharmaceutical composition described herein, or a combination thereof, for use in treating or preventing ARC in a subject. The present invention further provides the use of an antigen binding polypeptide, antigen binding polypeptide complex (e.g., antibody or antigen binding fragment thereof), polypeptide, polynucleotide, vector, cell, CAR or pharmaceutical composition described herein, or a combination thereof in the manufacture of a medicament for the treatment or prevention of ARC in a subject.

HIV-related opportunistic infections are illnesses that occur more frequently and/or more severely in subjects infected with HIV, due to their compromised immune systems. Examples of HIV-related opportunistic infections include, but are not limited to, candidiasis, invasive cervical cancer, coccidioidomycosis, cryptococcosis, cryptosporidiosis (Crypto), cystoisosporiasis, cytomegalovirus (CMV) infection, encephalopathy, herpes simplex virus (HSV) infection, histoplasmosis, Kaposi's sarcoma (KS), lymphoma, tuberculosis, Mycobacterium avium complex (MAC), Pneumocystis pneumonia (PCP), pneumonia, progressive multifocal leukoencephalopathy, Salmonella septicemia, toxoplasmosis, or wasting syndrome.

In some aspects, the invention is directed to a method of treating or preventing an HIV-related opportunistic infection, comprising administering to a subject in need thereof an antigen binding polypeptide, antigen binding polypeptide complex (e.g., antibody or antigen binding fragment thereof), polypeptide, polynucleotide, vector, CAR, cell or pharmaceutical composition described herein, or a combination thereof. In some aspects, the invention is directed to a method of treating or preventing an HIV-related opportunistic infection, comprising administering to a subject in need thereof a therapeutically effective amount of an antigen binding polypeptide, antigen binding polypeptide complex (e.g., antibody or antigen binding fragment thereof), polypeptide, polynucleotide, vector, CAR, cell or pharmaceutical composition described herein, or a combination thereof. The present invention further provides an antigen binding polypeptide, antigen binding polypeptide complex (e.g., antibody or antigen binding fragment thereof), polypeptide, polynucleotide, vector, cell, CAR or pharmaceutical composition described herein, or a combination thereof, for use in treating or preventing an HIV-related opportunistic infection in a subject. The present invention further provides the use of an antigen binding polypeptide, antigen binding polypeptide complex (e.g., antibody or antigen binding fragment thereof), polypeptide, polynucleotide, vector, cell, CAR or pharmaceutical composition described herein, or a combination thereof in the manufacture of a medicament for the treatment or prevention of an HIV-related opportunistic infection in a subject.

In some aspects of any of the methods disclosed herein, the HIV is HIV-1 or HIV-2.

Clauses relating to aspects of the invention:

1. An antigen binding polypeptide having a structure represented by:

VL1-VL2-VL3-VH3-VH2-VH1;
VH1-VH2-VH3-VL3-VL2-VL1;
VL1-VH2-VL3-VH3-VL2-VH1;
VH1-VL2-VH3-VL3-VH2-VL1;
VL1-VL2-VH3-VL3-VH2-VH1;
VH1-VH2-VL3-VH3-VL2-VL1;
VL1-VH2-VH3-VL3-VL2-VH1;
VH1-VL2-VL3-VH3-VH2-VL1;
VL1-L1-VL2-L2-VL3-L3-VH3-L4-VH2-L5-VH1;
VH1-L1-VH2-L2-VH3-L3-VL3-L4-VL2-L5-VL1;
VL1-L1-VH2-L2-VL3-L3-VH3-L4-VL2-L5-VH1;
VH1-L1-VL2-L2-VH3-L3-VL3-L4-VH2-L5-VL1;
VL1-L1-VL2-L2-VH3-L3-VL3-L4-VH2-L5-VH1;
VH1-L1-VH2-L2-VL3-L3-VH3-L4-VL2-L5-VL1;
VL1-L1-VH2-L2-VH3-L3-VL3-L4-VL2-L5-VH1; or
VH1-L1-VL2-L2-VL3-L3-VH3-L4-VH2-L5-VL1;
wherein:
VL1 is a first immunoglobulin light chain variable region;
VL2 is a second immunoglobulin light chain variable region;
VL3 is a third immunoglobulin light chain variable region;
VH1 is a first immunoglobulin heavy chain variable region;
VH2 is a second immunoglobulin heavy chain variable region;
VH3 is a third immunoglobulin heavy chain variable region; and
L1, L2, L3, L4 and L5 are amino acid linkers.

2. The antigen binding polypeptide of clause 1 having a structure represented by:
VL1-VL2-VL3-VH3-VH2-VH1-Fc;
VH1-VH2-VH3-VL3-VL2-VL1-Fc;

VL1-VH2-VL3-VH3-VL2-VH1-Fc;
VH1-VL2-VH3-VL3-VH2-VL1-Fc;
VL1-VL2-VH3-VL3-VH2-VH1-Fc;
VH1-VH2-VL3-VH3-VL2-VL1-Fc;
VL1-VH2-VH3-VL3-VL2-VH1-Fc;
VH1-VL2-VL3-VH3-VH2-VL1-Fc;
VL1-L1-VL2-L2-VL3-L3-VH3-L4-VH2-L5-VH1-Fc;
VL1-L1-VL2-L2-VL3-L3-VH3-L4-VH2-L5-VH1-L6-Fc;
VH1-L1-VH2-L2-VH3-L3-VL3-L4-VL2-L5-VL1-Fc;
VH1-L1-VH2-L2-VH3-L3-VL3-L4-VL2-L5-VL1-L6-Fc;
VL1-L1-VH2-L2-VL3-L3-VH3-L4-VL2-L5-VH1-Fc;
VL1-L1-VH2-L2-VL3-L3-VH3-L4-VL2-L5-VH1-L6-Fc;
VH1-L1-VL2-L2-VH3-L3-VL3-L4-VH2-L5-VL1-Fc;
VH1-L1-VL2-L2-VH3-L3-VL3-L4-VH2-L5-VL1-L6-Fc;
VL1-L1-VL2-L2-VH3-L3-VL3-L4-VH2-L5-VH1-Fc;
VL1-L1-VL2-L2-VH3-L3-VL3-L4-VH2-L5-VH1-L6-Fc;
VH1-L1-VH2-L2-VL3-L3-VH3-L4-VL2-L5-VL1-Fc;
VH1-L1-VH2-L2-VL3-L3-VH3-L4-VL2-L5-VL1-L6-Fc;
VL1-L1-VH2-L2-VH3-L3-VL3-L4-VL2-L5-VH1-Fc;
VL1-L1-VH2-L2-VH3-L3-VL3-L4-VL2-L5-VH1-L6-Fc;
VH1-L1-VL2-L2-VL3-L3-VH3-L4-VH2-L5-VL1-Fc; or
VH1-L1-VL2-L2-VL3-L3-VH3-L4-VH2-L5-VL1-L6-Fc;
wherein:
VL1 is a first immunoglobulin light chain variable region;
VL2 is a second immunoglobulin light chain variable region;
VL3 is a third immunoglobulin light chain variable region;
VH1 is a first immunoglobulin heavy chain variable region;
VH2 is a second immunoglobulin heavy chain variable region;
VH3 is a third immunoglobulin heavy chain variable region;
Fc is a region comprising an immunoglobulin heavy chain constant region 2 (CH2), an immunoglobulin heavy chain constant region 3 (CH3), and optionally, an immunoglobulin hinge; and
L1, L2, L3, L4, L5 and L6 are amino acid linkers.

3. The antigen binding polypeptide of clause 1 having a structure represented by:
VL1-VL2-VL3-VH3-VH2-VH1-Fc-Fc;
VH1-VH2-VH3-VL3-VL2-VL1-Fc-Fc;
VL1-VH2-VL3-VH3-VL2-VH1-Fc-Fc;
VH1-VL2-VH3-VL3-VH2-VL1-Fc-Fc;
VL1-VL2-VH3-VL3-VH2-VH1-Fc-Fc;
VH1-VH2-VL3-VH3-VL2-VL1-Fc-Fc;
VL1-VH2-VH3-VL3-VL2-VH1-Fc-Fc;
VH1-VL2-VL3-VH3-VH2-VL1-Fc-Fc;
VL1-L1-VL2-L2-VL3-L3-VH3-L4-VH2-L5-VH1-Fc-Fc;
VL1-L1-VL2-L2-VL3-L3-VH3-L4-VH2-L5-VH1-L6-Fc-Fc;
VL1-L1-VL2-L2-VL3-L3-VH3-L4-VH2-L5-VH1-L6-Fc-L7-Fc;
VH1-L1-VH2-L2-VH3-L3-VL3-L4-VL2-L5-VL1-Fc-Fc;
VH1-L1-VH2-L2-VH3-L3-VL3-L4-VL2-L5-VL1-L6-Fc-Fc;

VH1-L1-VH2-L2-VH3-L3-VL3-L4-VL2-L5-VL1-L6-
Fc-L7-Fc;
VL1-L1-VH2-L2-VL3-L3-VH3-L4-VL2-L5-VH1-Fc-
Fc;
VL1-L1-VH2-L2-VL3-L3-VH3-L4-VL2-L5-VH1-L6-
Fc-Fc;
VL1-L1-VH2-L2-VL3-L3-VH3-L4-VL2-L5-VH1-L6-
Fc-L7-Fc;
VH1-L1-VL2-L2-VH3-L3-VL3-L4-VH2-L5-VL1-Fc-
Fc;
VH1-L1-VL2-L2-VH3-L3-VL3-L4-VH2-L5-VL1-L6-
Fc-Fc;
VH1-L1-VL2-L2-VH3-L3-VL3-L4-VH2-L5-VL1-L6-
Fc-L7-Fc;
VL1-L1-VL2-L2-VH3-L3-VL3-L4-VH2-L5-VH1-Fc-
Fc;
VL1-L1-VL2-L2-VH3-L3-VL3-L4-VH2-L5-VH1-L6-
Fc-Fc;
VL1-L1-VL2-L2-VH3-L3-VL3-L4-VH2-L5-VH1-L6-
Fc-L7-Fc;
VH1-L1-VH2-L2-VL3-L3-VH3-L4-VL2-L5-VL1-Fc-
Fc;
VH1-L1-VH2-L2-VL3-L3-VH3-L4-VL2-L5-VL1-L6-
Fc-Fc;
VH1-L1-VH2-L2-VL3-L3-VH3-L4-VL2-L5-VL1-L6-
Fc-L7-Fc;
L1-L1-VH2-L2-VH3-L3-VL3-L4-VL2-L5-VH1-Fc-Fc;
VL1-L1-VH2-L2-VH3-L3-VL3-L4-VL2-L5-VH1-L6-
Fc-Fc;
VL1-L1-VH2-L2-VH3-L3-VL3-L4-VL2-L5-VH1-L6-
Fc-L7-Fc;
VH1-L1-VL2-L2-VL3-L3-VH3-L4-VH2-L5-VL1-Fc-
Fc;
VH1-L1-VL2-L2-VL3-L3-VH3-L4-VH2-L5-VL1-L6-
Fc-Fc; or
VH1-L1-VL2-L2-VL3-L3-VH3-L4-VH2-L5-VL1-L6-
Fc-L7-Fc;
wherein:
VL1 is a first immunoglobulin light chain variable region;
VL2 is a second immunoglobulin light chain variable
region;
VL3 is a third immunoglobulin light chain variable
region;
VH1 is a first immunoglobulin heavy chain variable
region;
VH2 is a second immunoglobulin heavy chain variable
region;
VH3 is a third immunoglobulin heavy chain variable
region;
Fc is a region comprising an immunoglobulin heavy chain
constant region 2 (CH2), an immunoglobulin heavy
chain constant region 3 (CH3), and optionally, an
immunoglobulin hinge; and
L1, L2, L3, L4, L5, L6 and L7 are amino acid linkers.
4. The antigen binding polypeptide of clause 1 having a
structure represented by:
VL1-VL2-VL3-VH3-VH2-VH1-CH1-CL;
VL1-VL2-VL3-VH3-VH2-VH1-CL-CH1;
VH1-VH2-VH3-VL3-VL2-VL1-CH1-CL;
VH1-VH2-VH3-VL3-VL2-VL1-CL-CH1;
VL1-VH2-VL3-VH3-VL2-VH1-CH1-CL;
VL1-VH2-VL3-VH3-VL2-VH1-CL-CH1;
VH1-VL2-VH3-VL3-VH2-VL1-CH1-CL;
VH1-VL2-VH3-VL3-VH2-VL1-CL-CH1;
VL1-VL2-VH3-VL3-VH2-VH1-CH1-CL;
VL1-VL2-VH3-VL3-VH2-VH1-CL-CH1;
VH1-VH2-VL3-VH3-VL2-VL1-CH1-CL;

VH1-VH2-VL3-VH3-VL2-VL1-CL-CH1;
VL1-VH2-VH3-VL3-VL2-VH1-CH1-CL;
VL1-VH2-VH3-VL3-VL2-VH1-CL-CH1;
VH1-VL2-VL3-VH3-VH2-VL1-CH1-CL;
VH1-VL2-VL3-VH3-VH2-VL1-CL-CH1;
VL1-L1-VL2-L2-VL3-L3-VH3-L4-VH2-L5-VH1-CH1-
CL;
VL1-L1-VL2-L2-VL3-L3-VH3-L4-VH2-L5-VH1-L6-
CH1-CL;
VL1-L1-VL2-L2-VL3-L3-VH3-L4-VH2-L5-VH1-L6-
CH1-L7-CL;
VL1-L1-VL2-L2-VL3-L3-VH3-L4-VH2-L5-VH1-CL-
CH1;
VL1-L1-VL2-L2-VL3-L3-VH3-L4-VH2-L5-VH1-L6-
CL-CH1;
VL1-L1-VL2-L2-VL3-L3-VH3-L4-VH2-L5-VH1-L6-
CL-L7-CH1;
VH1-L1-VH2-L2-VH3-L3-VL3-L4-VL2-L5-VL1-CH1-
CL;
VH1-L1-VH2-L2-VH3-L3-VL3-L4-VL2-L5-VL1-L6-
CH1-CL;
VH1-L1-VH2-L2-VH3-L3-VL3-L4-VL2-L5-VL1-L6-
CH1-L7-CL;
VH1-L1-VH2-L2-VH3-L3-VL3-L4-VL2-L5-VL1-CL-
CH1;
VH1-L1-VH2-L2-VH3-L3-VL3-L4-VL2-L5-VL1-L6-
CL-CH1;
VH1-L1-VH2-L2-VH3-L3-VL3-L4-VL2-L5-VL1-L6-
CL-L7-CH1;
VL1-L1-VH2-L2-VL3-L3-VH3-L4-VL2-L5-VH1-CH1-
CL;
VL1-L1-VH2-L2-VL3-L3-VH3-L4-VL2-L5-VH1-L6-
CH1-CL;
VL1-L1-VH2-L2-VL3-L3-VH3-L4-VL2-L5-VH1-L6-
CH1-L7-CL;
VL1-L1-VH2-L2-VL3-L3-VH3-L4-VL2-L5-VH1-CL-
CH1;
VL1-L1-VH2-L2-VL3-L3-VH3-L4-VL2-L5-VH1-L6-
CL-CH1;
VL1-L1-VH2-L2-VL3-L3-VH3-L4-VL2-L5-VH1-L6-
CL-L7-CH1;
VH1-L1-VL2-L2-VH3-L3-VL3-L4-VH2-L5-VL1-CH1-
CL;
VH1-L1-VL2-L2-VH3-L3-VL3-L4-VH2-L5-VL1-L6-
CH1-CL;
VH1-L1-VL2-L2-VH3-L3-VL3-L4-VH2-L5-VL1-L6-
CH1-L7-CL;
VH1-L1-VL2-L2-VH3-L3-VL3-L4-VH2-L5-VL1-CL-
CH1;
VH1-L1-VL2-L2-VH3-L3-VL3-L4-VH2-L5-VL1-L6-
CL-CH1;
VH1-L1-VL2-L2-VH3-L3-VL3-L4-VH2-L5-VL1-L6-
CL-L7-CH1;
VL1-L1-VL2-L2-VH3-L3-VL3-L4-VH2-L5-VH1-CH1-
CL;
VL1-L1-VL2-L2-VH3-L3-VL3-L4-VH2-L5-VH1-L6-
CH1-CL;
VL1-L1-VL2-L2-VH3-L3-VL3-L4-VH2-L5-VH1-L6-
CH1-L7-CL;
VL1-L1-VL2-L2-VH3-L3-VL3-L4-VH2-L5-VH1-CL-
CH1;
VL1-L1-VL2-L2-VH3-L3-VL3-L4-VH2-L5-VH1-L6-
CL-CH1;
VL1-L1-VL2-L2-VH3-L3-VL3-L4-VH2-L5-VH1-L6-
CL-L7-CH1;
VH1-L1-VH2-L2-VL3-L3-VH3-L4-VL2-L5-VL1-CH1-
CL;

VH1-L1-VH2-L2-VL3-L3-VH3-L4-VL2-L5-VL1-L6-CH1-CL;

VH1-L1-VH2-L2-VL3-L3-VH3-L4-VL2-L5-VL1-L6-CH1-L7-CL;

VH1-L1-VH2-L2-VL3-L3-VH3-L4-VL2-L5-VL1-CL-CH1;

VH1-L1-VH2-L2-VL3-L3-VH3-L4-VL2-L5-VL1-L6-CL-CH1;

VH1-L1-VH2-L2-VL3-L3-VH3-L4-VL2-L5-VL1-L6-CL-L7-CH1;

VL1-L1-VH2-L2-VH3-L3-VL3-L4-VL2-L5-VH1-CH1-CL;

VL1-L1-VH2-L2-VH3-L3-VL3-L4-VL2-L5-VH1-L6-CH1-CL;

VL1-L1-VH2-L2-VH3-L3-VL3-L4-VL2-L5-VH1-L6-CH1-L7-CL;

VL1-L1-VH2-L2-VH3-L3-VL3-L4-VL2-L5-VH1-CL-CH1;

VL1-L1-VH2-L2-VH3-L3-VL3-L4-VL2-L5-VH1-L6-CL-CH1;

VL1-L1-VH2-L2-VH3-L3-VL3-L4-VL2-L5-VH1-L6-CL-L7-CH1;

VH1-L1-VL2-L2-VL3-L3-VH3-L4-VH2-L5-VL1-CH1-CL;

VH1-L1-VL2-L2-VL3-L3-VH3-L4-VH2-L5-VL1-L6-CH1-CL;

VH1-L1-VL2-L2-VL3-L3-VH3-L4-VH2-L5-VL1-L6-CH1-L7-CL;

VH1-L1-VL2-L2-VL3-L3-VH3-L4-VH2-L5-VL1-CL-CH1;

VH1-L1-VL2-L2-VL3-L3-VH3-L4-VH2-L5-VL1-L6-CL-CH1; or

VH1-L1-VL2-L2-VL3-L3-VH3-L4-VH2-L5-VL1-L6-CL-L7-CH1;

wherein:

VL1 is a first immunoglobulin light chain variable region;

VL2 is a second immunoglobulin light chain variable region;

VL3 is a third immunoglobulin light chain variable region;

VH1 is a first immunoglobulin heavy chain variable region;

VH2 is a second immunoglobulin heavy chain variable region;

VH3 is a third immunoglobulin heavy chain variable region;

CH1 is a heavy chain constant region 1;

CL is a light chain constant region; and

L1, L2, L3, L4, L5, L6 and L7 are amino acid linkers.

5. The antigen binding polypeptide of clause 1 having a structure represented by:

VL1-VL2-VL3-VH3-VH2-VH1-CH3-CH3;

VH1-VH2-VH3-VL3-VL2-VL1-CH3-CH3;

VL1-VH2-VL3-VH3-VL2-VH1-CH3-CH3;

VH1-VL2-VH3-VL3-VH2-VL1-CH3-CH3;

VL1-VL2-VH3-VL3-VH2-VH1-CH3-CH3;

VH1-VH2-VL3-VH3-VL2-VL1-CH3-CH3;

VL1-VH2-VH3-VL3-VL2-VH1-CH3-CH3;

VH1-VL2-VL3-VH3-VH2-VL1-CH3-CH3;

VL1-L1-VL2-L2-VL3-L3-VH3-L4-VH2-L5-VH1-CH3-CH3;

VH1-L1-VH2-L2-VH3-L3-VL3-L4-VL2-L5-VL1-CH3-CH3;

VL1-L1-VH2-L2-VL3-L3-VH3-L4-VL2-L5-VH1-CH3-CH3;

VH1-L1-VL2-L2-VH3-L3-VL3-L4-VH2-L5-VL1-CH3-CH3;

VL1-L1-VL2-L2-VH3-L3-VL3-L4-VH2-L5-VH1-CH3-CH3;

VH1-L1-VH2-L2-VL3-L3-VH3-L4-VL2-L5-VL1-CH3-CH3;

VL1-L1-VH2-L2-VH3-L3-VL3-L4-VL2-L5-VH1-CH3-CH3;

VH1-L1-VL2-L2-VL3-L3-VH3-L4-VH2-L5-VL1-CH3-CH3;

VL1-L1-VL2-L2-VL3-L3-VH3-L4-VH2-L5-VH1-L6-CH3-CH3;

VH1-L1-VH2-L2-VH3-L3-VL3-L4-VL2-L5-VL1-L6-CH3-CH3;

VL1-L1-VH2-L2-VL3-L3-VH3-L4-VL2-L5-VH1-L6-CH3-CH3;

VH1-L1-VL2-L2-VH3-L3-VL3-L4-VH2-L5-VL1-L6-CH3-CH3;

VL1-L1-VL2-L2-VH3-L3-VL3-L4-VH2-L5-VH1-L6-CH3-CH3;

VH1-L1-VH2-L2-VL3-L3-VH3-L4-VL2-L5-VL1-L6-CH3-CH3;

VL1-L1-VH2-L2-VH3-L3-VL3-L4-VL2-L5-VH1-L6-CH3-CH3;

VH1-L1-VL2-L2-VL3-L3-VH3-L4-VH2-L5-VL1-L6-CH3-CH3;

VL1-L1-VL2-L2-VL3-L3-VH3-L4-VH2-L5-VH1-L6-CH3-L7-CH3;

VH1-L1-VH2-L2-VH3-L3-VL3-L4-VL2-L5-VL1-L6-CH3-L7-CH3;

VL1-L1-VH2-L2-VL3-L3-VH3-L4-VL2-L5-VH1-L6-CH3-L7-CH3;

VH1-L1-VL2-L2-VH3-L3-VL3-L4-VH2-L5-VL1-L6-CH3-L7-CH3;

VL1-L1-VL2-L2-VH3-L3-VL3-L4-VH2-L5-VH1-L6-CH3-L7-CH3;

VH1-L1-VH2-L2-VL3-L3-VH3-L4-VL2-L5-VL1-L6-CH3-L7-CH3;

VL1-L1-VH2-L2-VH3-L3-VL3-L4-VL2-L5-VH1-L6-CH3-L7-CH3; or

VH1-L1-VL2-L2-VL3-L3-VH3-L4-VH2-L5-VL1-L6-CH3-L7-CH3;

wherein:

VL1 is a first immunoglobulin light chain variable region;

VL2 is a second immunoglobulin light chain variable region;

VL3 is a third immunoglobulin light chain variable region;

VH1 is a first immunoglobulin heavy chain variable region;

VH2 is a second immunoglobulin heavy chain variable region;

VH3 is a third immunoglobulin heavy chain variable region;

CH3 is an immunoglobulin heavy chain constant region 3; and

L1, L2, L3, L4, L5, L6 and L7 are amino acid linkers.

6. An antigen binding polypeptide complex comprising a first polypeptide and a second polypeptide; wherein (i) the first polypeptide has a structure represented by:

VL1-VL2-VL3-VH3-VH2-VH1;

VH1-VH2-VH3-VL3-VL2-VL1;

VL1-VH2-VL3-VH3-VL2-VH1;

VH1-VL2-VH3-VL3-VH2-VL1;

VL1-VL2-VH3-VL3-VH2-VH1;

VH1-VH2-VL3-VH3-VL2-VL1;

VL1-VH2-VH3-VL3-VL2-VH1;

VH1-VL2-VL3-VH3-VH2-VL1;

VL1-L1-VL2-L2-VL3-L3-VH3-L4-VH2-L5-VH1;

VH1-L1-VH2-L2-VH3-L3-VL3-L4-VL2-L5-VL1;
VL1-L1-VH2-L2-VL3-L3-VH3-L4-VL2-L5-VH1;
VH1-L1-VL2-L2-VH3-L3-VL3-L4-VH2-L5-VL1;
VL1-L1-VL2-L2-VH3-L3-VL3-L4-VH2-L5-VH1;
VH1-L1-VH2-L2-VL3-L3-VH3-L4-VL2-L5-VL1; 5
VL1-L1-VH2-L2-VH3-L3-VL3-L4-VL2-L5-VH1; or
VH1-L1-VL2-L2-VL3-L3-VH3-L4-VH2-L5-VL1;
and the second polypeptide has a structure represented by:
Fc;
VL4-VH4; 10
VH4-VL4;
VL4-L6-VH4;
VH4-L6-VL4;
VL4-VL5-VH5-VH4;
VH4-VH5-VL5-VL4; 15
VL4-L6-VL5-L7-VH5-L8-VH4;
VH4-L6-VH5-L7-VL5-L8-VL4;
VL4-VL5-VL6-VH6-VH5-VH4;
VH4-VH5-VH6-VL6-VL5-VL4;
VL4-VH5-VL6-VH6-VL5-VH4; 20
VH4-VL5-VH6-VL6-VH5-VL4;
VL4-VL5-VH6-VL6-VH5-VH4;
VH4-VH5-VL6-VH6-VL5-VL4;
VL4-VH5-VH6-VL6-VL5-VH4;
VH4-VL5-VL6-VH6-VH5-VL4; 25
VL4-L6-VL5-L7-VL6-L8-VH6-L9-VH5-L10-VH4;
VH4-L6-VH5-L7-VH6-L8-VL6-L9-VL5-L10-VL4;
VL4-L6-VH5-L7-VL6-L8-VH6-L9-VL5-L10-VH4;
VH4-L6-VL5-L7-VH6-L8-VL6-L9-VH5-L10-VL4;
VL4-L6-VL5-L7-VH6-L8-VL6-L9-VH5-L10-VH4; 30
VH4-L6-VH5-L7-VL6-L8-VH6-L9-VL5-L10-VL4;
VL4-L6-VH5-L7-VH6-L8-VL6-L9-VL5-L10-VH4; or
VH4-L6-VL5-L7-VL6-L8-VH6-L9-VH5-L10-VL4;
wherein:
VL1 is a first immunoglobulin light chain variable region; 35
VL2 is a second immunoglobulin light chain variable
region;
VL3 is a third immunoglobulin light chain variable
region;
VL4 is a fourth immunoglobulin light chain variable 40
region;
VL5 is a fifth immunoglobulin light chain variable region;
VL6 is a sixth immunoglobulin light chain variable
region;
VH1 is a first immunoglobulin heavy chain variable 45
region;
VH2 is a second immunoglobulin heavy chain variable
region;
VH3 is a third immunoglobulin heavy chain variable
region; 50
VH4 is a fourth immunoglobulin heavy chain variable
region;
VH5 is a fifth immunoglobulin heavy chain variable
region;
VH6 is a sixth immunoglobulin heavy chain variable 55
region; and
L1, L2, L3, L4, L5, L6, L7, L8, L9 and L10 are amino
acid linkers;
(ii) the first polypeptide has a structure represented by:
VL1-VL2-VL3-VH3-VH2-VH1-Fc; 60
VH1-VH2-VH3-VL3-VL2-VL1-F c;
VL1-VH2-VL3-VH3-VL2-VH1-Fc;
VH1-VL2-VH3-VL3-VH2-VL1-Fc;
VL1-VL2-VH3-VL3-VH2-VH1-Fc;
VH1-VH2-VL3-VH3-VL2-VL1-Fc; 65
VL1-VH2-VH3-VL3-VL2-VH1-Fc;
VH1-VL2-VL3-VH3-VH2-VL1-Fc;

VL1-L1-VL2-L2-VL3-L3-VH3-L4-VH2-L5-VH1-Fc;
VL1-L1-VL2-L2-VL3-L3-VH3-L4-VH2-L5-VH1-L6-
Fc;
VH1-L1-VH2-L2-VH3-L3-VL3-L4-VL2-L5-VL1-Fc;
VH1-L1-VH2-L2-VH3-L3-VL3-L4-VL2-L5-VL1-L6-
Fc;
VL1-L1-VH2-L2-VL3-L3-VH3-L4-VL2-L5-VH1-Fc;
VL1-L1-VH2-L2-VL3-L3-VH3-L4-VL2-L5-VH1-L6-
Fc;
VH1-L1-VL2-L2-VH3-L3-VL3-L4-VH2-L5-VL1-Fc;
VH1-L1-VL2-L2-VH3-L3-VL3-L4-VH2-L5-VL1-L6-
Fc;
VL1-L1-VL2-L2-VH3-L3-VL3-L4-VH2-L5-VH1-Fc;
VL1-L1-VL2-L2-VH3-L3-VL3-L4-VH2-L5-VH1-L6-
Fc;
VH1-L1-VH2-L2-VL3-L3-VH3-L4-VL2-L5-VL1-Fc;
VH1-L1-VH2-L2-VL3-L3-VH3-L4-VL2-L5-VL1-L6-
Fc;
VL1-L1-VH2-L2-VH3-L3-VL3-L4-VL2-L5-VH1-Fc;
VL1-L1-VH2-L2-VH3-L3-VL3-L4-VL2-L5-VH1-L6-
Fc;
VH1-L1-VL2-L2-VL3-L3-VH3-L4-VH2-L5-VL1-Fc; or
VH1-L1-VL2-L2-VL3-L3-VH3-L4-VH2-L5-VL1-L6-
Fc;
and the second polypeptide has a structure represented by:
Fc;
VL4-VH4-Fc;
VH4-VL4-Fc;
VL4-L7-VH4-Fc;
VH4-L7-VL4-Fc;
VL4-L7-VH4-L8-Fc;
VH4-L7-VL4-L8-Fc;
VL4-CL-VH4-CH1-Fc;
VH4-CL-VL4-CH1-Fc;
VL4-CH1-VH4-CL-Fc;
VH4-CH1-VL4-CL-Fc;
VL4-L7-CL-L8-VH4-L9-CH1-Fc;
VL4-L7-CL-L8-VH4-L9-CH1-L10-Fc;
VH4-L7-CL-L8-VL4-L9-CH1-Fc;
VH4-L7-CL-L8-VL4-L9-CH1-L10-Fc;
VL4-L7-CH1-L8-VH4-L9-CL-Fc;
VL4-L7-CH1-L8-VH4-L9-CL-L10-Fc;
VH4-L7-CH1-L8-VL4-L9-CL-Fc;
VH4-L7-CH1-L8-VL4-L9-CL-L10-Fc;
VL4-VL5-VH5-VH4-Fc;
VH4-VH5-VL5-VL4-Fc;
VL4-L7-VL5-L8-VH5-L9-VH4-Fc;
VH4-L7-VH5-L8-VL5-L9-VL4-Fc;
VL4-L7-VL5-L8-VH5-L9-VH4-L10-Fc;
VH4-L7-VH5-L8-VL5-L9-VL4-L10-Fc;
VL4-VL5-VL6-VH6-VH5-VH4-Fc;
VH4-VH5-VH6-VL6-VL5-VL4-Fc;
VL4-VH5-VL6-VH6-VL5-VH4-Fc;
VH4-VL5-VH6-VL6-VH5-VL4-Fc;
VL4-VL5-VH6-VL6-VH5-VH4-Fc;
VH4-VH5-VL6-VH6-VL5-VL4-Fc;
VL4-VH5-VH6-VL6-VL5-VH4-Fc;
VH4-VL5-VL6-VH6-VH5-VL4-Fc;
VL4-L7-VL5-L8-VL6-L9-VH6-L10-VH5-L11-VH4-Fc;
VH4-L7-VH5-L8-VH6-L9-VL6-L10-VL5-L11-VL4-Fc;
VL4-L7-VH5-L8-VL6-L9-VH6-L10-VL5-L11-VH4-Fc;
VH4-L7-VL5-L8-VH6-L9-VL6-L10-VH5-L11-VL4-Fc;
VL4-L7-VL5-L8-VH6-L9-VL6-L10-VH5-L11-VH4-Fc;
VH4-L7-VH5-L8-VL6-L9-VH6-L10-VL5-L11-VL4-Fc;
VL4-L7-VH5-L8-VH6-L9-VL6-L10-VL5-L11-VH4-Fc;
VH4-L7-VL5-L8-VL6-L9-VH6-L10-VH5-L11-VL4-Fc;

VL4-L7-VL5-L8-VL6-L9-VH6-L10-VH5-L11-VH4-L12-Fc;

VH4-L7-VH5-L8-VH6-L9-VL6-L10-VL5-L11-VL4-L12-Fc;

VL4-L7-VH5-L8-VL6-L9-VH6-L10-VL5-L11-VH4-L12-Fc;

VH4-L7-VL5-L8-VH6-L9-VL6-L10-VH5-L11-VL4-L12-Fc;

VL4-L7-VL5-L8-VH6-L9-VL6-L10-VH5-L11-VH4-L12-Fc;

VH4-L7-VH5-L8-VL6-L9-VH6-L10-VL5-L11-VL4-L12-Fc;

VL4-L7-VH5-L8-VH6-L9-VL6-L10-VL5-L11-VH4-L12-Fc; or

VH4-L7-VL5-L8-VL6-L9-VH6-L10-VH5-L11-VL4-L12-Fc;

wherein:

VL1 is a first immunoglobulin light chain variable region;

VL2 is a second immunoglobulin light chain variable region;

VL3 is a third immunoglobulin light chain variable region;

VL4 is a fourth immunoglobulin light chain variable region;

VL5 is a fifth immunoglobulin light chain variable region;

VL6 is a sixth immunoglobulin light chain variable region;

VH1 is a first immunoglobulin heavy chain variable region;

VH2 is a second immunoglobulin heavy chain variable region;

VH3 is a third immunoglobulin heavy chain variable region;

VH4 is a fourth immunoglobulin heavy chain variable region;

VH5 is a fifth immunoglobulin heavy chain variable region;

VH6 is a sixth immunoglobulin heavy chain variable region;

Fc is a region comprising an immunoglobulin heavy chain constant region 2 (CH2), an immunoglobulin heavy chain constant region 3 (CH3), and optionally, an immunoglobulin hinge;

CH1 is a heavy chain constant region 1;

CL is a light chain constant region; and

L1, L2, L3, L4, L5, L6, L7, L8, L9, L10, L11 and L12 are amino acid linkers;

(iii) the first polypeptide has a structure represented by:

VL1-VL2-VL3-VH3-VH2-VH1-CH1;

VL1-VL2-VL3-VH3-VH2-VH1-CL;

VL1-VL2-VL3-VH3-VH2-VH1-CH1-CL;

VL1-VL2-VL3-VH3-VH2-VH1-CL-CH1;

VH1-VH2-VH3-VL3-VL2-VL1-CH1;

VH1-VH2-VH3-VL3-VL2-VL1-CL;

VH1-VH2-VH3-VL3-VL2-VL1-CH1-CL;

VH1-VH2-VH3-VL3-VL2-VL1-CL-CH1;

VL1-VH2-VL3-VH3-VL2-VH1-CH1;

VL1-VH2-VL3-VH3-VL2-VH1-CL;

VL1-VH2-VL3-VH3-VL2-VH1-CH1-CL;

VL1-VH2-VL3-VH3-VL2-VH1-CL-CH1;

VH1-VL2-VH3-VL3-VH2-VL1-CH1;

VH1-VL2-VH3-VL3-VH2-VL1-CL;

VH1-VL2-VH3-VL3-VH2-VL1-CH1-CL;

VH1-VL2-VH3-VL3-VH2-VL1-CL-CH1;

VL1-VL2-VH3-VL3-VH2-VH1-CH1;

VL1-VL2-VH3-VL3-VH2-VH1-CL;

VL1-VL2-VH3-VL3-VH2-VH1-CH1-CL;

VL1-VL2-VH3-VL3-VH2-VH1-CL-CH1;

VH1-VH2-VL3-VH3-VL2-VL1-CH1;

VH1-VH2-VL3-VH3-VL2-VL1-CL;

VH1-VH2-VL3-VH3-VL2-VL1-CH1-CL;

VH1-VH2-VL3-VH3-VL2-VL1-CL-CH1;

VL1-VH2-VH3-VL3-VL2-VH1-CH1;

VL1-VH2-VH3-VL3-VL2-VH1-CL;

VL1-VH2-VH3-VL3-VL2-VH1-CH1-CL;

VL1-VH2-VH3-VL3-VL2-VH1-CL-CH1;

VH1-VL2-VL3-VH3-VH2-VL1-CH1;

VH1-VL2-VL3-VH3-VH2-VL1-CL;

VH1-VL2-VL3-VH3-VH2-VL1-CH1-CL;

VH1-VL2-VL3-VH3-VH2-VL1-CL-CH1;

VL1-L1-VL2-L2-VL3-L3-VH3-L4-VH2-L5-VH1-CH1;

VL1-L1-VL2-L2-VL3-L3-VH3-L4-VH2-L5-VH1-L6-CH1;

VL1-L1-VL2-L2-VL3-L3-VH3-L4-VH2-L5-VH1-CL;

VL1-L1-VL2-L2-VL3-L3-VH3-L4-VH2-L5-VH1-L6-CL;

VL1-L1-VL2-L2-VL3-L3-VH3-L4-VH2-L5-VH1-CH1-CL;

VL1-L1-VL2-L2-VL3-L3-VH3-L4-VH2-L5-VH1-L6-CH1-CL;

VL1-L1-VL2-L2-VL3-L3-VH3-L4-VH2-L5-VH1-L6-CH1-L7-CL;

VL1-L1-VL2-L2-VL3-L3-VH3-L4-VH2-L5-VH1-CL-CH1;

VL1-L1-VL2-L2-VL3-L3-VH3-L4-VH2-L5-VH1-L6-CL-CH1;

VL1-L1-VL2-L2-VL3-L3-VH3-L4-VH2-L5-VH1-L6-CL-L7-CH1;

VH1-L1-VH2-L2-VH3-L3-VL3-L4-VL2-L5-VL1-CH1;

VH1-L1-VH2-L2-VH3-L3-VL3-L4-VL2-L5-VL1-L6-CH1;

VH1-L1-VH2-L2-VH3-L3-VL3-L4-VL2-L5-VL1-CL;

VH1-L1-VH2-L2-VH3-L3-VL3-L4-VL2-L5-VL1-L6-CL;

VH1-L1-VH2-L2-VH3-L3-VL3-L4-VL2-L5-VL1-CH1-CL;

VH1-L1-VH2-L2-VH3-L3-VL3-L4-VL2-L5-VL1-L6-CH1-CL;

VH1-L1-VH2-L2-VH3-L3-VL3-L4-VL2-L5-VL1-L6-CH1-L7-CL;

VH1-L1-VH2-L2-VH3-L3-VL3-L4-VL2-L5-VL1-CL-CH1;

VH1-L1-VH2-L2-VH3-L3-VL3-L4-VL2-L5-VL1-L6-CL-CH1;

VH1-L1-VH2-L2-VH3-L3-VL3-L4-VL2-L5-VL1-L6-CL-L7-CH1;

VL1-L1-VH2-L2-VL3-L3-VH3-L4-VL2-L5-VH1-CH1;

VL1-L1-VH2-L2-VL3-L3-VH3-L4-VL2-L5-VH1-L6-CH1;

VL1-L1-VH2-L2-VL3-L3-VH3-L4-VL2-L5-VH1-CL;

VL1-L1-VH2-L2-VL3-L3-VH3-L4-VL2-L5-VH1-L6-CL;

VL1-L1-VH2-L2-VL3-L3-VH3-L4-VL2-L5-VH1-CH1-CL;

VL1-L1-VH2-L2-VL3-L3-VH3-L4-VL2-L5-VH1-L6-CH1-CL;

VL1-L1-VH2-L2-VL3-L3-VH3-L4-VL2-L5-VH1-L6-CH1-L7-CL;

VL1-L1-VH2-L2-VL3-L3-VH3-L4-VL2-L5-VH1-CL-CH1;

VL1-L1-VH2-L2-VL3-L3-VH3-L4-VL2-L5-VH1-L6-CL-CH1;

VL1-L1-VH2-L2-VL3-L3-VH3-L4-VL2-L5-VH1-L6-CL-L7-CH1;

VH1-L1-VL2-L2-VH3-L3-VL3-L4-VH2-L5-VL1-CH1;
VH1-L1-VL2-L2-VH3-L3-VL3-L4-VH2-L5-VL1-L6-CH1;
VH1-L1-VL2-L2-VH3-L3-VL3-L4-VH2-L5-VL1-CL;
VH1-L1-VL2-L2-VH3-L3-VL3-L4-VH2-L5-VL1-L6-CL;
VH1-L1-VL2-L2-VH3-L3-VL3-L4-VH2-L5-VL1-CH1-CL;
VH1-L1-VL2-L2-VH3-L3-VL3-L4-VH2-L5-VL1-L6-CH1-CL;
VH1-L1-VL2-L2-VH3-L3-VL3-L4-VH2-L5-VL1-L6-CH1-L7-CL;
VH1-L1-VL2-L2-VH3-L3-VL3-L4-VH2-L5-VL1-CL-CH1;
VH1-L1-VL2-L2-VH3-L3-VL3-L4-VH2-L5-VL1-L6-CL-CH1;
VH1-L1-VL2-L2-VH3-L3-VL3-L4-VH2-L5-VL1-L6-CL-L7-CH1;
VL1-L1-VL2-L2-VH3-L3-VL3-L4-VH2-L5-VH1-CH1;
VL1-L1-VL2-L2-VH3-L3-VL3-L4-VH2-L5-VH1-L6-CH1;
VL1-L1-VL2-L2-VH3-L3-VL3-L4-VH2-L5-VH1-CL;
VL1-L1-VL2-L2-VH3-L3-VL3-L4-VH2-L5-VH1-L6-CL;
VL1-L1-VL2-L2-VH3-L3-VL3-L4-VH2-L5-VH1-CH1-CL;
VL1-L1-VL2-L2-VH3-L3-VL3-L4-VH2-L5-VH1-L6-CH1-CL;
VL1-L1-VL2-L2-VH3-L3-VL3-L4-VH2-L5-VH1-L6-CH1-L7-CL;
VL1-L1-VL2-L2-VH3-L3-VL3-L4-VH2-L5-VH1-CL-CH1;
VL1-L1-VL2-L2-VH3-L3-VL3-L4-VH2-L5-VH1-L6-CL-CH1;
VL1-L1-VL2-L2-VH3-L3-VL3-L4-VH2-L5-VH1-L6-CL-L7-CH1;
VH1-L1-VH2-L2-VL3-L3-VH3-L4-VL2-L5-VL1-CH1;
VH1-L1-VH2-L2-VL3-L3-VH3-L4-VL2-L5-VL1-L6-CH1;
VH1-L1-VH2-L2-VL3-L3-VH3-L4-VL2-L5-VL1-CL;
VH1-L1-VH2-L2-VL3-L3-VH3-L4-VL2-L5-VL1-L6-CL;
VH1-L1-VH2-L2-VL3-L3-VH3-L4-VL2-L5-VL1-CH1-CL;
VH1-L1-VH2-L2-VL3-L3-VH3-L4-VL2-L5-VL1-L6-CH1-CL;
VH1-L1-VH2-L2-VL3-L3-VH3-L4-VL2-L5-VL1-L6-CH1-L7-CL;
VH1-L1-VH2-L2-VL3-L3-VH3-L4-VL2-L5-VL1-CL-CH1;
VH1-L1-VH2-L2-VL3-L3-VH3-L4-VL2-L5-VL1-L6-CL-CH1;
VH1-L1-VH2-L2-VL3-L3-VH3-L4-VL2-L5-VL1-L6-CL-L7-CH1;
VL1-L1-VH2-L2-VL3-L3-VL3-L4-VL2-L5-VH1-CH1;
VL1-L1-VH2-L2-VL3-L3-VL3-L4-VL2-L5-VH1-L6-CH1;
VL1-L1-VH2-L2-VL3-L3-VL3-L4-VL2-L5-VH1-CL;
VL1-L1-VH2-L2-VL3-L3-VL3-L4-VL2-L5-VH1-L6-CL;
VL1-L1-VH2-L2-VL3-L3-VL3-L4-VL2-L5-VH1-CH1-CL;
VL1-L1-VH2-L2-VL3-L3-VL3-L4-VL2-L5-VH1-L6-CH1-CL;
VL1-L1-VH2-L2-VL3-L3-VL3-L4-VL2-L5-VH1-L6-CH1-L7-CL;

VL1-L1-VH2-L2-VH3-L3-VL3-L4-VL2-L5-VH1-CL-CH1;
VL1-L1-VH2-L2-VH3-L3-VL3-L4-VL2-L5-VH1-L6-CL-CH1;
VL1-L1-VH2-L2-VH3-L3-VL3-L4-VL2-L5-VH1-L6-CL-L7-CH1;
VH1-L1-VL2-L2-VL3-L3-VH3-L4-VH2-L5-VL1-CH1;
VH1-L1-VL2-L2-VL3-L3-VH3-L4-VH2-L5-VL1-L6-CH1;
VH1-L1-VL2-L2-VL3-L3-VH3-L4-VH2-L5-VL1-CL;
VH1-L1-VL2-L2-VL3-L3-VH3-L4-VH2-L5-VL1-L6-CL;
VH1-L1-VL2-L2-VL3-L3-VH3-L4-VH2-L5-VL1-CH1-CL;
VH1-L1-VL2-L2-VL3-L3-VH3-L4-VH2-L5-VL1-L6-CH1-CL;
VH1-L1-VL2-L2-VL3-L3-VH3-L4-VH2-L5-VL1-L6-CH1-L7-CL;
VH1-L1-VL2-L2-VL3-L3-VH3-L4-VH2-L5-VL1-CL-CH1;
VH1-L1-VL2-L2-VL3-L3-VH3-L4-VH2-L5-VL1-L6-CL-CH1; or
VH1-L1-VL2-L2-VL3-L3-VH3-L4-VH2-L5-VL1-L6-CL-L7-CH1;

and the second polypeptide has a structure represented by:
VL4-VH4-CH1;
VL4-VH4-CL;
VL4-VH4-CH1-CL;
VL4-VH4-CL-CH1;
VH4-VL4-CH1;
VH4-VL4-CL;
VH4-VL4-CH1-CL;
VH4-VL4-CL-CH1;
VL4-L8-VH4-CH1;
VL4-L8-VH4-CL;
VL4-L8-VH4-CH1-CL;
VL4-L8-VH4-CL-CH1;
VH4-L8-VL4-CH1;
VH4-L8-VL4-CL;
VH4-L8-VH4-CH1-CL;
VH4-L8-VH4-CL-CH1;
VL4-VL5-VH5-VH4-CH1;
VL4-VL5-VH5-VH4-CL;
VL4-VL5-VH5-VH4-CH1-CL;
VL4-VL5-VH5-VH4-CL-CH1;
VH4-VH5-VL5-VL4-CH1;
VH4-VH5-VL5-VL4-CL;
VH4-VH5-VL5-VL4-CH1-CL;
VH4-VH5-VL5-VL4-CL-CH1;
VL4-L8-VL5-L9-VH5-L10-VH4-CH1;
VL4-L8-VL5-L9-VH5-L10-VH4-CL;
VL4-L8-VL5-L9-VH5-L10-VH4-CH1-CL;
VL4-L8-VL5-L9-VH5-L10-VH4-CL-CH1;
VH4-L8-VH5-L9-VL5-L10-VL4-CH1;
VH4-L8-VH5-L9-VL5-L10-VL4-CL;
VH4-L8-VH5-L9-VL5-L10-VL4-CH1-CL;
VH4-L8-VH5-L9-VL5-L10-VL4-CL-CH1;
VL4-VL5-VL6-VH6-VH5-VH4-CH1;
VL4-VL5-VL6-VH6-VH5-VH4-CL;
VL4-VL5-VL6-VH6-VH5-VH4-CH1-CL;
VL4-VL5-VL6-VH6-VH5-VH4-CL-CH1;
VH4-VH5-VH6-VL6-VL5-VL4-CH1;
VH4-VH5-VH6-VL6-VL5-VL4-CL;
VH4-VH5-VH6-VL6-VL5-VL4-CH1-CL;
VH4-VH5-VH6-VL6-VL5-VL4-CL-CH1;
VL4-VH5-VL6-VH6-VL5-VH4-CH1;
VL4-VH5-VL6-VH6-VL5-VH4-CL;

VL4-VH5-VL6-VH6-VL5-VH4-CH1-CL;
VL4-VH5-VL6-VH6-VL5-VH4-CL-CH1;
VH4-VL5-VH6-VL6-VH5-VL4-CH1;
VH4-VL5-VH6-VL6-VH5-VL4-CL;
VH4-VL5-VH6-VL6-VH5-VL4-CH1-CL;
VH4-VL5-VH6-VL6-VH5-VL4-CL-CH1;
VL4-VL5-VH6-VL6-VH5-VH4-CH1;
VL4-VL5-VH6-VL6-VH5-VH4-CL;
VL4-VL5-VH6-VL6-VH5-VH4-CH1-CL;
VL4-VL5-VH6-VL6-VH5-VH4-CL-CH1;
VH4-VH5-VL6-VH6-VL5-VL4-CH1;
VH4-VH5-VL6-VH6-VL5-VL4-CL;
VH4-VH5-VL6-VH6-VL5-VL4-CH1-CL;
VH4-VH5-VL6-VH6-VL5-VL4-CL-CH1;
VL4-VH5-VH6-VL6-VL5-VH4-CH1;
VL4-VH5-VH6-VL6-VL5-VH4-CL;
VL4-VH5-VH6-VL6-VL5-VH4-CH1-CL;
VL4-VH5-VH6-VL6-VL5-VH4-CL-CH1;
VH4-VL5-VL6-VH6-VH5-VL4-CH1;
VH4-VL5-VL6-VH6-VH5-VL4-CL;
VH4-VL5-VL6-VH6-VH5-VL4-CH1-CL;
VH4-VL5-VL6-VH6-VH5-VL4-CL-CH1;
VL4-L8-VL5-L9-VL6-L10-VH6-L11-VH5-L12-VH4-
  CH1;
VL4-L8-VL5-L9-VL6-L10-VH6-L11-VH5-L12-VH4-
  CL;
VL4-L8-VL5-L9-VL6-L10-VH6-L11-VH5-L12-VH4-
  CH1-CL;
VL4-L8-VL5-L9-VL6-L10-VH6-L11-VH5-L12-VH4-
  CL-CH1;
VH4-L8-VH5-L9-VH6-L10-VL6-L11-VL5-L12-VL4-
  CH1;
VH4-L8-VH5-L9-VH6-L10-VL6-L11-VL5-L12-VL4-
  CL;
VH4-L8-VH5-L9-VH6-L10-VL6-L11-VL5-L12-VL4-
  CH1-CL;
VH4-L8-VH5-L9-VH6-L10-VL6-L11-VL5-L12-VL4-
  CL-CH1;
VL4-L8-VH5-L9-VL6-L10-VH6-L11-VL5-L12-VH4-
  CH1;
VL4-L8-VH5-L9-VL6-L10-VH6-L11-VL5-L12-VH4-
  CL;
VL4-L8-VH5-L9-VL6-L10-VH6-L11-VL5-L12-VH4-
  CH1-CL;
VL4-L8-VH5-L9-VL6-L10-VH6-L11-VL5-L12-VH4-
  CL-CH1;
VH4-L8-VL5-L9-VH6-L10-VL6-L11-VH5-L12-VL4-
  CH1;
VH4-L8-VL5-L9-VH6-L10-VL6-L11-VH5-L12-VL4-
  CL;
VH4-L8-VL5-L9-VH6-L10-VL6-L11-VH5-L12-VL4-
  CH1-CL;
VH4-L8-VL5-L9-VH6-L10-VL6-L11-VH5-L12-VL4-
  CL-CH1;
VL4-L8-VL5-L9-VH6-L10-VL6-L11-VH5-L12-VH4-
  CH1;
VL4-L8-VL5-L9-VH6-L10-VL6-L11-VH5-L12-VH4-
  CL;
VL4-L8-VL5-L9-VH6-L10-VL6-L11-VH5-L12-VH4-
  CH1-CL;
VL4-L8-VL5-L9-VH6-L10-VL6-L11-VH5-L12-VH4-
  CL-CH1;
VH4-L8-VH5-L9-VL6-L10-VH6-L11-VL5-L12-VL4-
  CH1;
VH4-L8-VH5-L9-VL6-L10-VH6-L11-VL5-L12-VL4-
  CL;

VH4-L8-VH5-L9-VL6-L10-VH6-L11-VL5-L12-VL4-
  CH1-CL;
VH4-L8-VH5-L9-VL6-L10-VH6-L11-VL5-L12-VL4-
  CL-CH1;
VL4-L8-VH5-L9-VH6-L10-VL6-L11-VL5-L12-VH4-
  CH1;
VL4-L8-VH5-L9-VH6-L10-VL6-L11-VL5-L12-VH4-
  CL;
VL4-L8-VH5-L9-VH6-L10-VL6-L11-VL5-L12-VH4-
  CH1-CL;
VL4-L8-VH5-L9-VH6-L10-VL6-L11-VL5-L12-VH4-
  CL-CH1;
VH4-L8-VL5-L9-VL6-L10-VH6-L11-VH5-L12-VL4-
  CH1;
VH4-L8-VL5-L9-VL6-L10-VH6-L11-VH5-L12-VL4-
  CL;
VH4-L8-VL5-L9-VL6-L10-VH6-L11-VH5-L12-VL4-
  CH1-CL;
VH4-L8-VL5-L9-VL6-L10-VH6-L11-VH5-L12-VL4-
  CL-CH1;
VL4-L8-VL5-L9-VL6-L10-VH6-L11-VH5-L12-VH4-
  L13-CH1;
VL4-L8-VL5-L9-VL6-L10-VH6-L11-VH5-L12-VH4-
  L13-CL;
VL4-L8-VL5-L9-VL6-L10-VH6-L11-VH5-L12-VH4-
  L13-CH1-CL;
VL4-L8-VL5-L9-VL6-L10-VH6-L11-VH5-L12-VH4-
  L13-CL-CH1;
VH4-L8-VH5-L9-VH6-L10-VL6-L11-VL5-L12-VL4-
  L13-CH1;
VH4-L8-VH5-L9-VH6-L10-VL6-L11-VL5-L12-VL4-
  L13-CL;
VH4-L8-VH5-L9-VH6-L10-VL6-L11-VL5-L12-VL4-
  L13-CH1-CL;
VH4-L8-VH5-L9-VH6-L10-VL6-L11-VL5-L12-VL4-
  L13-CL-CH1;
VL4-L8-VH5-L9-VL6-L10-VH6-L11-VL5-L12-VH4-
  L13-CH1;
VL4-L8-VH5-L9-VL6-L10-VH6-L11-VL5-L12-VH4-
  L13-CL;
VL4-L8-VH5-L9-VL6-L10-VH6-L11-VL5-L12-VH4-
  L13-CH1-CL;
VL4-L8-VH5-L9-VL6-L10-VH6-L11-VL5-L12-VH4-
  L13-CL-CH1;
VH4-L8-VL5-L9-VH6-L10-VL6-L11-VH5-L12-VL4-
  L13-CH1;
VH4-L8-VL5-L9-VH6-L10-VL6-L11-VH5-L12-VL4-
  L13-CL;
VH4-L8-VL5-L9-VH6-L10-VL6-L11-VH5-L12-VL4-
  L13-CH1-CL;
VH4-L8-VL5-L9-VH6-L10-VL6-L11-VH5-L12-VL4-
  L13-CL-CH1;
VL4-L8-VL5-L9-VH6-L10-VL6-L11-VH5-L12-VH4-
  L13-CH1;
VL4-L8-VL5-L9-VH6-L10-VL6-L11-VH5-L12-VH4-
  L13-CL;
VL4-L8-VL5-L9-VH6-L10-VL6-L11-VH5-L12-VH4-
  L13-CH1-CL;
VL4-L8-VL5-L9-VH6-L10-VL6-L11-VH5-L12-VH4-
  L13-CL-CH1;
VH4-L8-VH5-L9-VL6-L10-VH6-L11-VL5-L12-VL4-
  L13-CH1;
VH4-L8-VH5-L9-VL6-L10-VH6-L11-VL5-L12-VL4-
  L13-CL;
VH4-L8-VH5-L9-VL6-L10-VH6-L11-VL5-L12-VL4-
  L13-CH1-CL;

VH4-L8-VH5-L9-VL6-L10-VH6-L11-VL5-L12-VL4-
L13-CL-CH1;
VL4-L8-VH5-L9-VH6-L10-VL6-L11-VL5-L12-VH4-
L13-CH1;
VL4-L8-VH5-L9-VH6-L10-VL6-L11-VL5-L12-VH4-
L13-CL;
VL4-L8-VH5-L9-VH6-L10-VL6-L11-VL5-L12-VH4-
L13-CH1-CL;
VL4-L8-VH5-L9-VH6-L10-VL6-L11-VL5-L12-VH4-
L13-CH1;
VH4-L8-VL5-L9-VL6-L10-VH6-L11-VH5-L12-VL4-
L13-CH1;
VH4-L8-VL5-L9-VL6-L10-VH6-L11-VH5-L12-VL4-
L13-CL;
VH4-L8-VL5-L9-VL6-L10-VH6-L11-VH5-L12-VL4-
L13-CH1-CL; or
VH4-L8-VL5-L9-VL6-L10-VH6-L11-VH5-L12-VL4-
L13-CL-CH1;
wherein:
VL1 is a first immunoglobulin light chain variable region;
VL2 is a second immunoglobulin light chain variable
region;
VL3 is a third immunoglobulin light chain variable
region;
VL4 is a fourth immunoglobulin light chain variable
region;
VL5 is a fifth immunoglobulin light chain variable region;
VL6 is a sixth immunoglobulin light chain variable
region;
VH1 is a first immunoglobulin heavy chain variable
region;
VH2 is a second immunoglobulin heavy chain variable
region;
VH3 is a third immunoglobulin heavy chain variable
region;
VH4 is a fourth immunoglobulin heavy chain variable
region;
VH5 is a fifth immunoglobulin heavy chain variable
region;
VH6 is a sixth immunoglobulin heavy chain variable
region;
CH1 is a heavy chain constant region 1;
CL is a light chain constant region; and
L1, L2, L3, L4, L5, L6, L7, L8, L9, L10, L11, L12 and
L13 are amino acid linkers;
or
(iv) the first polypeptide has a structure represented by:
VL1-VL2-VL3-VH3-VH2-VH1-CH1-Fc;
VH1-VH2-VH3-VL3-VL2-VL1-CH1-Fc;
VL1-VH2-VL3-VH3-VL2-VH1-CH1-Fc;
VH1-VL2-VH3-VL3-VH2-VL1-CH1-Fc;
VL1-VL2-VH3-VL3-VH2-VH1-CH1-Fc;
VH1-VH2-VL3-VH3-VL2-VL1-CH1-Fc;
VL1-VH2-VH3-VL3-VL2-VH1-CH1-Fc;
VH1-VL2-VL3-VH3-VH2-VL1-CH1-Fc;
VL1-VL2-VL3-VH3-VH2-VH1-CL-Fc;
VH1-VH2-VH3-VL3-VL2-VL1-CL-Fc;
VL1-VH2-VL3-VH3-VL2-VH1-CL-Fc;
VH1-VL2-VH3-VL3-VH2-VL1-CL-Fc;
VL1-VL2-VH3-VL3-VH2-VH1-CL-Fc;
VH1-VH2-VL3-VH3-VL2-VL1-CL-Fc;
VL1-VH2-VH3-VL3-VL2-VH1-CL-Fc;
VH1-VL2-VL3-VH3-VH2-VL1-CL-Fc;
VL1-VL2-VL3-VH3-VH2-VH1-CH1-CL-Fc;
VH1-VH2-VH3-VL3-VL2-VL1-CH1-CL-Fc;
VL1-VH2-VL3-VH3-VL2-VH1-CH1-CL-Fc;
VH1-VL2-VH3-VL3-VH2-VL1-CH1-CL-Fc;

VL1-VL2-VH3-VL3-VH2-VH1-CH1-CL-Fc;
VH1-VH2-VL3-VH3-VL2-VL1-CH1-CL-Fc;
VL1-VH2-VH3-VL3-VL2-VH1-CH1-CL-Fc;
VH1-VL2-VL3-VH3-VH2-VL1-CH1-CL-Fc;
VL1-VL2-VL3-VH3-VH2-VH1-CL-CH1-Fc;
VH1-VH2-VH3-VL3-VL2-VL1-CL-CH1-Fc;
VL1-VH2-VL3-VH3-VL2-VH1-CL-CH1-Fc;
VH1-VL2-VH3-VL3-VH2-VL1-CL-CH1-Fc;
VL1-VL2-VH3-VL3-VH2-VH1-CL-CH1-Fc;
VH1-VH2-VL3-VH3-VL2-VL1-CL-CH1-Fc;
VL1-VH2-VH3-VL3-VL2-VH1-CL-CH1-Fc;
VH1-VL2-VL3-VH3-VH2-VL1-CL-CH1-Fc;
VL1-L1-VL2-L2-VL3-L3-VH3-L4-VH2-L5-VH1-CH1-
Fc;
VH1-L1-VH2-L2-VH3-L3-VL3-L4-VL2-L5-VL1-CH1-
Fc;
VL1-L1-VH2-L2-VL3-L3-VH3-L4-VL2-L5-VH1-CH1-
Fc;
VH1-L1-VL2-L2-VH3-L3-VL3-L4-VH2-L5-VL1-CH1-
Fc;
VL1-L1-VL2-L2-VH3-L3-VL3-L4-VH2-L5-VH1-CH1-
Fc;
VH1-L1-VH2-L2-VL3-L3-VH3-L4-VL2-L5-VL1-CH1-
Fc;
VL1-L1-VH2-L2-VH3-L3-VL3-L4-VL2-L5-VH1-CH1-
Fc;
VH1-L1-VL2-L2-VL3-L3-VH3-L4-VH2-L5-VL1-CH1-
Fc;
VL1-L1-VL2-L2-VL3-L3-VH3-L4-VH2-L5-VH1-CL-
Fc;
VH1-L1-VH2-L2-VH3-L3-VL3-L4-VL2-L5-VL1-CL-
Fc;
VL1-L1-VH2-L2-VL3-L3-VH3-L4-VL2-L5-VH1-CL-
Fc;
VH1-L1-VL2-L2-VH3-L3-VL3-L4-VH2-L5-VL1-CL-
Fc;
VL1-L1-VL2-L2-VH3-L3-VL3-L4-VH2-L5-VH1-CL-
Fc;
VH1-L1-VH2-L2-VL3-L3-VH3-L4-VL2-L5-VL1-CL-
Fc;
VL1-L1-VH2-L2-VH3-L3-VL3-L4-VL2-L5-VH1-CL-
Fc;
VH1-L1-VL2-L2-VL3-L3-VH3-L4-VH2-L5-VL1-CL-
Fc;
VL1-L1-VL2-L2-VL3-L3-VH3-L4-VH2-L5-VH1-CH1-
CL-Fc;
VH1-L1-VH2-L2-VH3-L3-VL3-L4-VL2-L5-VL1-CH1-
CL-Fc;
VL1-L1-VH2-L2-VL3-L3-VH3-L4-VL2-L5-VH1-CH1-
CL-Fc;
VH1-L1-VL2-L2-VH3-L3-VL3-L4-VH2-L5-VL1-CH1-
CL-Fc;
VL1-L1-VL2-L2-VH3-L3-VL3-L4-VH2-L5-VH1-CH1-
CL-Fc;
VH1-L1-VH2-L2-VL3-L3-VH3-L4-VL2-L5-VL1-CH1-
CL-Fc;
VL1-L1-VH2-L2-VH3-L3-VL3-L4-VL2-L5-VH1-CH1-
CL-Fc;
VH1-L1-VL2-L2-VL3-L3-VH3-L4-VH2-L5-VL1-CH1-
CL-Fc;
VL1-L1-VL2-L2-VL3-L3-VH3-L4-VH2-L5-VH1-CL-
CH1-Fc;
VH1-L1-VH2-L2-VH3-L3-VL3-L4-VL2-L5-VL1-CL-
CH1-Fc;
VL1-L1-VH2-L2-VL3-L3-VH3-L4-VL2-L5-VH1-CL-
CH1-Fc;

VH1-L1-VL2-L2-VH3-L3-VL3-L4-VH2-L5-VL1-CL-
CH1-Fc;
VL1-L1-VL2-L2-VH3-L3-VL3-L4-VH2-L5-VH1-CL-
CH1-Fc;
VH1-L1-VH2-L2-VL3-L3-VH3-L4-VL2-L5-VL1-CL-
CH1-Fc;
VL1-L1-VH2-L2-VH3-L3-VL3-L4-VL2-L5-VH1-CL-
CH1-Fc; or
VH1-L1-VL2-L2-VL3-L3-VH3-L4-VH2-L5-VL1-CL-
CH1-Fc
and the second polypeptide has a structure represented by:
Fc;
VL4-VH4-CH1-Fc;
VL4-VH4-CL-Fc;
VL4-VH4-CH1-CL-Fc;
VL4-VH4-CL-CH1-Fc;
VH4-VL4-CH1-Fc;
VH4-VL4-CL-Fc;
VH4-VL4-CH1-CL-Fc;
VH4-VL4-CL-CH1-Fc;
VL4-L6-VH4-CH1-Fc;
VL4-L6-VH4-CL-Fc;
VL4-L6-VH4-CH1-CL-Fc;
VL4-L6-VH4-CL-CH1-Fc;
VH4-L6-VL4-CH1-Fc;
VH4-L6-VL4-CL-Fc;
VH4-L6-VL4-CH1-CL-Fc;
VH4-L6-VL4-CL-CH1-Fc;
VL4-VL5-VH5-VH4-CH1-Fc;
VL4-VL5-VH5-VH4-CL-Fc;
VL4-VL5-VH5-VH4-CH1-CL-Fc;
VL4-VL5-VH5-VH4-CL-CH1-Fc;
VH4-VH5-VL5-VL4-CH1-Fc;
VH4-VH5-VL5-VL4-CL-Fc;
VH4-VH5-VL5-VL4-CH1-CL-Fc;
VH4-VH5-VL5-VL4-CL-CH1-Fc;
VL4-L6-VL5-L7-VH5-L8-VH4-CH1-Fc;
VL4-L6-VL5-L7-VH5-L8-VH4-CL-Fc;
VL4-L6-VL5-L7-VH5-L8-VH4-CH1-CL-Fc;
VL4-L6-VL5-L7-VH5-L8-VH4-CL-CH1-Fc;
VH4-L6-VH5-L7-VL5-L8-VL4-CH1-Fc;
VH4-L6-VH5-L7-VL5-L8-VL4-CL-Fc;
VH4-L6-VH5-L7-VL5-L8-VL4-CH1-CL-Fc;
VH4-L6-VH5-L7-VL5-L8-VL4-CL-CH1-Fc;
VL4-VL5-VL6-VH6-VH5-VH4-CH1-Fc;
VL4-VL5-VL6-VH6-VH5-VH4-CL-Fc;
VL4-VL5-VL6-VH6-VH5-VH4-CH1-CL-Fc;
VL4-VL5-VL6-VH6-VH5-VH4-CL-CH1-Fc;
VH4-VH5-VH6-VL6-VL5-VL4-CH1-Fc;
VH4-VH5-VH6-VL6-VL5-VL4-CL-Fc;
VH4-VH5-VH6-VL6-VL5-VL4-CH1-CL-Fc;
VH4-VH5-VH6-VL6-VL5-VL4-CL-CH1-Fc;
VL4-VH5-VL6-VH6-VL5-VH4-CH1-Fc;
VL4-VH5-VL6-VH6-VL5-VH4-CL-Fc;
VL4-VH5-VL6-VH6-VL5-VH4-CH1-CL-Fc;
VL4-VH5-VL6-VH6-VL5-VH4-CL-CH1-Fc;
VH4-VL5-VH6-VL6-VH5-VL4-CH1-Fc;
VH4-VL5-VH6-VL6-VH5-VL4-CL-Fc;
VH4-VL5-VH6-VL6-VH5-VL4-CH1-CL-Fc;
VH4-VL5-VH6-VL6-VH5-VL4-CL-CH1-Fc;
VL4-VL5-VH6-VL6-VH5-VH4-CH1-Fc;
VL4-VL5-VH6-VL6-VH5-VH4-CL-Fc;
VL4-VL5-VH6-VL6-VH5-VH4-CH1-CL-Fc;
VL4-VL5-VH6-VL6-VH5-VH4-CL-CH1-Fc;
VH4-VH5-VL6-VH6-VL5-VL4-CH1-Fc;
VH4-VH5-VL6-VH6-VL5-VL4-CL-Fc;
VH4-VH5-VL6-VH6-VL5-VL4-CH1-CL-Fc;

VH4-VH5-VL6-VH6-VL5-VL4-CL-CH1-Fc;
VL4-VH5-VH6-VL6-VL5-VH4-CH1-Fc;
VL4-VH5-VH6-VL6-VL5-VH4-CL-Fc;
VL4-VH5-VH6-VL6-VL5-VH4-CH1-CL-Fc;
VL4-VH5-VH6-VL6-VL5-VH4-CL-CH1-Fc;
VH4-VL5-VL6-VH6-VH5-VL4-CH1-Fc;
VH4-VL5-VL6-VH6-VH5-VL4-CL-Fc;
VH4-VL5-VL6-VH6-VH5-VL4-CH1-CL-Fc;
VH4-VL5-VL6-VH6-VH5-VL4-CL-CH1-Fc;
VL4-L6-VL5-L7-VL6-L8-VH6-L9-VH5-L10-VH4-
CH1-Fc;
VL4-L6-VL5-L7-VL6-L8-VH6-L9-VH5-L10-VH4-CL-
Fc;
VL4-L6-VL5-L7-VL6-L8-VH6-L9-VH5-L10-VH4-
CH1-CL-Fc;
VL4-L6-VL5-L7-VL6-L8-VH6-L9-VH5-L10-VH4-CL-
CH1-Fc;
VH4-L6-VH5-L7-VH6-L8-VL6-L9-VL5-L10-VL4-
CH1-Fc;
VH4-L6-VH5-L7-VH6-L8-VL6-L9-VL5-L10-VL4-CL-
Fc;
VH4-L6-VH5-L7-VH6-L8-VL6-L9-VL5-L10-VL4-
CH1-CL-Fc;
VH4-L6-VH5-L7-VH6-L8-VL6-L9-VL5-L10-VL4-CL-
CH1-Fc;
VL4-L6-VH5-L7-VL6-L8-VH6-L9-VL5-L10-VH4-
CH1-Fc;
VL4-L6-VH5-L7-VL6-L8-VH6-L9-VL5-L10-VH4-CL-
Fc;
VL4-L6-VH5-L7-VL6-L8-VH6-L9-VL5-L10-VH4-
CH1-CL-Fc;
VL4-L6-VH5-L7-VL6-L8-VH6-L9-VL5-L10-VH4-CL-
CH1-Fc;
VH4-L6-VL5-L7-VH6-L8-VL6-L9-VH5-L10-VL4-
CH1-Fc;
VH4-L6-VL5-L7-VH6-L8-VL6-L9-VH5-L10-VL4-CL-
Fc;
VH4-L6-VL5-L7-VH6-L8-VL6-L9-VH5-L10-VL4-
CH1-CL-Fc;
VH4-L6-VL5-L7-VH6-L8-VL6-L9-VH5-L10-VL4-CL-
CH1-Fc;
VL4-L6-VL5-L7-VH6-L8-VL6-L9-VH5-L10-VH4-
CH1-Fc;
VL4-L6-VL5-L7-VH6-L8-VL6-L9-VH5-L10-VH4-CL-
Fc;
VL4-L6-VL5-L7-VH6-L8-VL6-L9-VH5-L10-VH4-
CH1-CL-Fc;
VL4-L6-VL5-L7-VH6-L8-VL6-L9-VH5-L10-VH4-CL-
CH1-Fc;
VH4-L6-VH5-L7-VL6-L8-VH6-L9-VL5-L10-VL4-
CH1-Fc;
VH4-L6-VH5-L7-VL6-L8-VH6-L9-VL5-L10-VL4-CL-
Fc;
VH4-L6-VH5-L7-VL6-L8-VH6-L9-VL5-L10-VL4-
CH1-CL-Fc;
VH4-L6-VH5-L7-VL6-L8-VH6-L9-VL5-L10-VL4-CL-
CH1-Fc;
VL4-L6-VH5-L7-VH6-L8-VL6-L9-VL5-L10-VH4-
CH1-Fc;
VL4-L6-VH5-L7-VH6-L8-VL6-L9-VL5-L10-VH4-CL-
Fc;
VL4-L6-VH5-L7-VH6-L8-VL6-L9-VL5-L10-VH4-
CH1-CL-Fc;
VL4-L6-VH5-L7-VH6-L8-VL6-L9-VL5-L10-VH4-CL-
CH1-Fc;
VH4-L6-VL5-L7-VL6-L8-VH6-L9-VH5-L10-VL4-
CH1-Fc;

VH4-L6-VL5-L7-VL6-L8-VH6-L9-VH5-L10-VL4-CL-Fc;

VH4-L6-VL5-L7-VL6-L8-VH6-L9-VH5-L10-VL4-CH1-CL-Fc;

VH4-L6-VL5-L7-VL6-L8-VH6-L9-VH5-L10-VL4-CL-CH1-Fc;

VL4-L6-VL5-L7-VL6-L8-VH6-L9-VH5-L10-VH4-L11-CH1-Fc;

VL4-L6-VL5-L7-VL6-L8-VH6-L9-VH5-L10-VH4-L11-CL-Fc;

VL4-L6-VL5-L7-VL6-L8-VH6-L9-VH5-L10-VH4-L11-CH1-CL-Fc;

VL4-L6-VL5-L7-VL6-L8-VH6-L9-VH5-L10-VH4-L11-CL-CH1-Fc;

VH4-L6-VH5-L7-VH6-L8-VL6-L9-VL5-L10-VL4-L11-CH1-Fc;

VH4-L6-VH5-L7-VH6-L8-VL6-L9-VL5-L10-VL4-L11-CL-Fc;

VH4-L6-VH5-L7-VH6-L8-VL6-L9-VL5-L10-VL4-L11-CH1-CL-Fc;

VH4-L6-VH5-L7-VH6-L8-VL6-L9-VL5-L10-VL4-L11-CL-CH1-Fc;

VL4-L6-VH5-L7-VL6-L8-VH6-L9-VL5-L10-VH4-L11-CH1-Fc;

VL4-L6-VH5-L7-VL6-L8-VH6-L9-VL5-L10-VH4-L11-CL-Fc;

VL4-L6-VH5-L7-VL6-L8-VH6-L9-VL5-L10-VH4-L11-CH1-CL-Fc;

VL4-L6-VH5-L7-VL6-L8-VH6-L9-VL5-L10-VH4-L11-CL-CH1-Fc;

VH4-L6-VL5-L7-VH6-L8-VL6-L9-VH5-L10-VL4-L11-CH1-Fc;

VH4-L6-VL5-L7-VH6-L8-VL6-L9-VH5-L10-VL4-L11-CL-Fc;

VH4-L6-VL5-L7-VH6-L8-VL6-L9-VH5-L10-VL4-L11-CH1-CL-Fc;

VH4-L6-VL5-L7-VH6-L8-VL6-L9-VH5-L10-VL4-L11-CL-CH1-Fc;

VL4-L6-VL5-L7-VH6-L8-VL6-L9-VH5-L10-VH4-L11-CH1-Fc;

VL4-L6-VL5-L7-VH6-L8-VL6-L9-VH5-L10-VH4-L11-CL-Fc;

VL4-L6-VL5-L7-VH6-L8-VL6-L9-VH5-L10-VH4-L11-CH1-CL-Fc;

VL4-L6-VL5-L7-VH6-L8-VL6-L9-VH5-L10-VH4-L11-CL-CH1-Fc;

VH4-L6-VH5-L7-VL6-L8-VH6-L9-VL5-L10-VL4-L11-CH1-Fc;

VH4-L6-VH5-L7-VL6-L8-VH6-L9-VL5-L10-VL4-L11-CL-Fc;

VH4-L6-VH5-L7-VL6-L8-VH6-L9-VL5-L10-VL4-L11-CH1-CL-Fc;

VH4-L6-VH5-L7-VL6-L8-VH6-L9-VL5-L10-VL4-L11-CL-CH1-Fc;

VL4-L6-VH5-L7-VH6-L8-VL6-L9-VL5-L10-VH4-L11-CH1-Fc;

VL4-L6-VH5-L7-VH6-L8-VL6-L9-VL5-L10-VH4-L11-CL-Fc;

VL4-L6-VH5-L7-VH6-L8-VL6-L9-VL5-L10-VH4-L11-CH1-CL-Fc;

VL4-L6-VH5-L7-VH6-L8-VL6-L9-VL5-L10-VH4-L11-CL-CH1-Fc;

VH4-L6-VL5-L7-VL6-L8-VH6-L9-VH5-L10-VL4-L11-CH1-Fc;

VH4-L6-VL5-L7-VL6-L8-VH6-L9-VH5-L10-VL4-L11-CL-Fc;

VH4-L6-VL5-L7-VL6-L8-VH6-L9-VH5-L10-VL4-L11-CH1-CL-Fc; or

VH4-L6-VL5-L7-VL6-L8-VH6-L9-VH5-L10-VL4-L11-CL-CH1-Fc;

wherein:

VL1 is a first immunoglobulin light chain variable region;

VL2 is a second immunoglobulin light chain variable region;

VL3 is a third immunoglobulin light chain variable region;

VL4 is a fourth immunoglobulin light chain variable region;

VL5 is a fifth immunoglobulin light chain variable region;

VL6 is a sixth immunoglobulin light chain variable region;

VH1 is a first immunoglobulin heavy chain variable region;

VH2 is a second immunoglobulin heavy chain variable region;

VH3 is a third immunoglobulin heavy chain variable region;

VH4 is a fourth immunoglobulin heavy chain variable region;

VH5 is a fifth immunoglobulin heavy chain variable region;

VH6 is a sixth immunoglobulin heavy chain variable region;

Fc is a region comprising an immunoglobulin heavy chain constant region 2 (CH2), an immunoglobulin heavy chain constant region 3 (CH3), and optionally, an immunoglobulin hinge;

CH1 is a heavy chain constant region 1;

CL is a light chain constant region; and

L1, L2, L3, L4, L5, L6, L7, L8, L9, L10 and L11 are amino acid linkers.

7. An antigen binding polypeptide complex comprising a first polypeptide, a second polypeptide, and a third polypeptide; wherein:

(i) the first polypeptide has a structure represented by:

VL1-VL2-VL3-VH3-VH2-VH1;

VH1-VH2-VH3-VL3-VL2-VL1;

VL1-VH2-VL3-VH3-VL2-VH1;

VH1-VL2-VH3-VL3-VH2-VL1;

VL1-VL2-VH3-VL3-VH2-VH1;

VH1-VH2-VL3-VH3-VL2-VL1;

VL1-VH2-VH3-VL3-VL2-VH1;

VH1-VL2-VL3-VH3-VH2-VL1;

VL1-L1-VL2-L2-VL3-L3-VH3-L4-VH2-L5-VH1;

VH1-L1-VH2-L2-VH3-L3-VL3-L4-VL2-L5-VL1;

VL1-L1-VH2-L2-VL3-L3-VH3-L4-VL2-L5-VH1;

VH1-L1-VL2-L2-VH3-L3-VL3-L4-VH2-L5-VL1;

VL1-L1-VL2-L2-VH3-L3-VL3-L4-VH2-L5-VH1;

VH1-L1-VH2-L2-VL3-L3-VH3-L4-VL2-L5-VL1;

VL1-L1-VH2-L2-VH3-L3-VL3-L4-VL2-L5-VH1; or

VH1-L1-VL2-L2-VL3-L3-VH3-L4-VH2-L5-VL1;

the second polypeptide has a structure represented by:

VL4-VL5;

VL4-L6-VL5;

VL4-VL5-VL6; or

VL4-L6-VL5-L7-VL6;

and the third polypeptide has a structure represented by:

VH4-VH5;

VH4-L6-VH5;

VH4-VH5-VH6; or

VH4-L6-VH5-L7-VH6;

wherein:

VL1 is a first immunoglobulin light chain variable region;

VL2 is a second immunoglobulin light chain variable region;

VL3 is a third immunoglobulin light chain variable region;

VL4 is a fourth immunoglobulin light chain variable region;

VL5 is a fifth immunoglobulin light chain variable region;

VL6 is a sixth immunoglobulin light chain variable region;

VH1 is a first immunoglobulin heavy chain variable region;

VH2 is a second immunoglobulin heavy chain variable region;

VH3 is a third immunoglobulin heavy chain variable region;

VH4 is a fourth immunoglobulin heavy chain variable region;

VH5 is a fifth immunoglobulin heavy chain variable region;

VH6 is a sixth immunoglobulin heavy chain variable region; and

L1, L2, L3, L4, L5, L6 and L7 are amino acid linkers;

(ii) the first polypeptide has a structure represented by:

VL1-VL2-VL3-VH3-VH2-VH1;

VH1-VH2-VH3-VL3-VL2-VL1;

VL1-VH2-VL3-VH3-VL2-VH1;

VH1-VL2-VH3-VL3-VH2-VL1;

VL1-VL2-VH3-VL3-VH2-VH1;

VH1-VH2-VL3-VH3-VL2-VL1;

VL1-VH2-VH3-VL3-VL2-VH1;

VH1-VL2-VL3-VH3-VH2-VL1;

VL1-L1-VL2-L2-VL3-L3-VH3-L4-VH2-L5-VH1;

VH1-L1-VH2-L2-VH3-L3-VL3-L4-VL2-L5-VL1;

VL1-L1-VH2-L2-VL3-L3-VH3-L4-VL2-L5-VH1;

VH1-L1-VL2-L2-VH3-L3-VL3-L4-VH2-L5-VL1;

VL1-L1-VL2-L2-VH3-L3-VL3-L4-VH2-L5-VH1;

VH1-L1-VH2-L2-VL3-L3-VH3-L4-VL2-L5-VL1;

VL1-L1-VH2-L2-VH3-L3-VL3-L4-VL2-L5-VH1; or

VH1-L1-VL2-L2-VL3-L3-VH3-L4-VH2-L5-VL1;

the second polypeptide has a structure represented by:

VL4-VL5;

VL4-L6-VL5;

VL4-VL5-VL6;

VL4-L6-VL5-L7-VL6;

VL4-CL;

VL4-L6-CL;

VL4-VL5-CL;

VL4-L6-VL5-CL;

VL4-L6-VL5-L7-CL;

VL4-VL5-VL6-CL;

VL4-L6-VL5-L7-VL6-CL;

VL4-L6-VL5-L7-VL6-L8-CL;

VL4-CH1;

VL4-L6-CH1;

VL4-VL5-CH1;

VL4-L6-VL5-CH1;

VL4-L6-VL5-L7-CH1;

VL4-VL5-VL6-CH1;

VL4-L6-VL5-L7-VL6-CH1; or

VL4-L6-VL5-L7-VL6-L8-CH1;

and the third polypeptide has a structure represented by:

VH4-VH5;

VH4-L9-VH5;

VH4-VH5-VH6;

VH4-L9-VH5-L10-VH6;

VH4-CH1;

VH4-L9-CH1;

VH4-VH5-CH1;

VH4-L9-VH5-CH1;

VH4-L9-VH5-L10-CH1;

VH4-VH5-VH6-CH1;

VH4-L9-VH5-L10-VH6-CH1;

VH4-L9-VH5-L10-VH6-L11-CH1;

VH4-CL;

VH4-L9-CL;

VH4-VH5-CL;

VH4-L9-VH5-CL;

VH4-L9-VH5-L10-CL;

VH4-VH5-VH6-CL;

VH4-L9-VH5-L10-VH6-CL; or

VH4-L9-VH5-L10-VH6-L11-CL wherein:

VL1 is a first immunoglobulin light chain variable region;

VL2 is a second immunoglobulin light chain variable region;

VL3 is a third immunoglobulin light chain variable region;

VL4 is a fourth immunoglobulin light chain variable region;

VL5 is a fifth immunoglobulin light chain variable region;

VL6 is a sixth immunoglobulin light chain variable region;

VH1 is a first immunoglobulin heavy chain variable region;

VH2 is a second immunoglobulin heavy chain variable region;

VH3 is a third immunoglobulin heavy chain variable region;

VH4 is a fourth immunoglobulin heavy chain variable region;

VH5 is a fifth immunoglobulin heavy chain variable region;

VH6 is a sixth immunoglobulin heavy chain variable region;

CH1 is a heavy chain constant region 1;

CL is a light chain constant region; and

L1, L2, L3, L4, L5, L6, L7, L8, L9, L10 and L11 are amino acid linkers;

(iii) the first polypeptide has a structure represented by:

VL1-VL2-VL3-VH3-VH2-VH1-Fc;

VH1-VH2-VH3-VL3-VL2-VL1-Fc;

VL1-VH2-VL3-VH3-VL2-VH1-Fc;

VH1-VL2-VH3-VL3-VH2-VL1-Fc;

VL1-VL2-VH3-VL3-VH2-VH1-Fc;

VH1-VH2-VL3-VH3-VL2-VL1-Fc;

VL1-VH2-VH3-VL3-VL2-VH1-Fc;

VH1-VL2-VL3-VH3-VH2-VL1-Fc;

VL1-L1-VL2-L2-VL3-L3-VH3-L4-VH2-L5-VH1-Fc;

VL1-L1-VL2-L2-VL3-L3-VH3-L4-VH2-L5-VH1-L6-Fc;

VH1-L1-VH2-L2-VH3-L3-VL3-L4-VL2-L5-VL1-Fc;

VH1-L1-VH2-L2-VH3-L3-VL3-L4-VL2-L5-VL1-L6-Fc;

VL1-L1-VH2-L2-VL3-L3-VH3-L4-VL2-L5-VH1-Fc;

VL1-L1-VH2-L2-VL3-L3-VH3-L4-VL2-L5-VH1-L6-Fc;

VH1-L1-VL2-L2-VH3-L3-VL3-L4-VH2-L5-VL1-Fc;

VH1-L1-VL2-L2-VH3-L3-VL3-L4-VH2-L5-VL1-L6-Fc;

VL1-L1-VL2-L2-VH3-L3-VL3-L4-VH2-L5-VH1-Fc;

VL1-L1-VL2-L2-VH3-L3-VL3-L4-VH2-L5-VH1-L6-Fc;

VH1-L1-VH2-L2-VL3-L3-VH3-L4-VL2-L5-VL1-Fc;

VH1-L1-VH2-L2-VL3-L3-VH3-L4-VL2-L5-VL1-L6-Fc;

VL1-L1-VH2-L2-VH3-L3-VL3-L4-VL2-L5-VH1-Fc;

VL1-L1-VH2-L2-VH3-L3-VL3-L4-VL2-L5-VH1-L6-Fc;

VH1-L1-VL2-L2-VL3-L3-VH3-L4-VH2-L5-VL1-Fc; or

VH1-L1-VL2-L2-VL3-L3-VH3-L4-VH2-L5-VL1-L6-Fc;

the second polypeptide has a structure represented by:

VL4-VL5;

VL4-L7-VL5;

VL4-CL;

VL4-L7-CL;

VL4-CH1;

VL4-L7-CH1;

VH4-VH5;

VH4-L7-VH5;

VH4-CL;

VH4-L7-CL;

VH4-CH1;

VH4-L7-CH1;

VL4-VL5-VL6;

VL4-L7-VL5-L8-VL6;

VL4-VL5-VL6-CL;

VL4-L7-VL5-L8-VL6-CL;

VL4-L7-VL5-L8-VL6-L9-CL;

VL4-VL5-VL6-CH1;

VL4-L7-VL5-L8-VL6-CH1;

VL4-L7-VL5-L8-VL6-L9-CH1;

VH4-VH5-VH6;

VH4-L7-VH5-L8-VH6;

VH4-VH5-VH6-CL;

VH4-L7-VH5-L8-VH6-CL;

VH4-L7-VH5-L8-VH6-L9-CL;

VH4-VH5-VH6-CH1;

VH4-L7-VH5-L8-VH6-CH1; or

VH4-L7-VH5-L8-VH6-L9-CH1;

and the third polypeptide has a structure represented by:

VH4-VH5-Fc;

VH4-L10-VH5-Fc;

VH4-L10-VH5-L11-Fc;

VH4-CH1-Fc;

VH4-L10-CH1-Fc;

VH4-L10-CH1-L11-Fc;

VH4-CL-Fc;

VH4-L10-CL-Fc;

VH4-L10-CL-L11-Fc;

VH4-VH5-Fc;

VH4-L10-VH5-Fc;

VH4-L10-VH5-L11-Fc;

VH4-VH5-VH6-Fc;

VH4-L10-VH5-L11-VH6-Fc;

VH4-L10-VH5-L11-VH6-L12-Fc;

VH4-VH5-VH6-CH1-Fc;

VH4-L10-VH5-L11-VH6-CH1-Fc;

VH4-L10-VH5-L11-VH6-L12-CH1-Fc;

VH4-L10-VH5-L11-VH6-L12-CH1-L13-Fc;

VH4-VH5-VH6-CL-Fc;

VH4-L10-VH5-L11-VH6-CL-Fc;

VH4-L10-VH5-L11-VH6-L12-CL-Fc;

VH4-L10-VH5-L11-VH6-L12-CL-L13-Fc;

VL4-VL5-VL6-Fc;

VL4-L10-VL5-L11-VL6-Fc;

VL4-L10-VL5-L11-VL6-L12-Fc;

VL4-VL5-VL6-CH1-Fc;

VL4-L10-VL5-L11-VL6-CH1-Fc;

VL4-L10-VL5-L11-VL6-L12-CH1-Fc;

VL4-L10-VL5-L11-VL6-L12-CH1-L13-Fc;

VL4-VL5-VL6-CL-Fc;

VL4-L10-VL5-L11-VL6-CL-Fc;

VL4-L10-VL5-L11-VL6-L12-CL-Fc; or

VL4-L10-VL5-L11-VL6-L12-CL-L13-Fc;

wherein:

VL1 is a first immunoglobulin light chain variable region;

VL2 is a second immunoglobulin light chain variable region;

VL3 is a third immunoglobulin light chain variable region;

VL4 is a fourth immunoglobulin light chain variable region;

VL5 is a fifth immunoglobulin light chain variable region;

VL6 is a sixth immunoglobulin light chain variable region;

VH1 is a first immunoglobulin heavy chain variable region;

VH2 is a second immunoglobulin heavy chain variable region;

VH3 is a third immunoglobulin heavy chain variable region;

VH4 is a fourth immunoglobulin heavy chain variable region;

VH5 is a fifth immunoglobulin heavy chain variable region;

VH6 is a sixth immunoglobulin heavy chain variable region;

Fc is a region comprising an immunoglobulin heavy chain constant region 2 (CH2), an immunoglobulin heavy chain constant region 3 (CH3), and optionally, an immunoglobulin hinge;

CH1 is a heavy chain constant region 1;

CL is a light chain constant region; and

L1, L2, L3, L4, L5, L6, L7, L8, L9, L10, L11, L12 and L13 are amino acid linkers;

or (iv) the first polypeptide has a structure represented by:

VL1-VL2-VL3-VH3-VH2-VH1-Fc;

VH1-VH2-VH3-VL3-VL2-VL1-Fc;

VL1-VH2-VL3-VH3-VL2-VH1-Fc;

VH1-VL2-VH3-VL3-VH2-VL1-Fc;

VL1-VL2-VH3-VL3-VH2-VH1-Fc;

VH1-VH2-VL3-VH3-VL2-VL1-Fc;

VL1-VH2-VH3-VL3-VL2-VH1-Fc;

VH1-VL2-VL3-VH3-VH2-VL1-Fc;

VL1-L1-VL2-L2-VL3-L3-VH3-L4-VH2-L5-VH1-Fc;

VL1-L1-VL2-L2-VL3-L3-VH3-L4-VH2-L5-VH1-L6-Fc;

VH1-L1-VH2-L2-VH3-L3-VL3-L4-VL2-L5-VL1-Fc;

VH1-L1-VH2-L2-VH3-L3-VL3-L4-VL2-L5-VL1-L6-Fc;

VL1-L1-VH2-L2-VL3-L3-VH3-L4-VL2-L5-VH1-Fc;

VL1-L1-VH2-L2-VL3-L3-VH3-L4-VL2-L5-VH1-L6-Fc;

VH1-L1-VL2-L2-VH3-L3-VL3-L4-VH2-L5-VL1-Fc;

VH1-L1-VL2-L2-VH3-L3-VL3-L4-VH2-L5-VL1-L6-Fc;

VL1-L1-VL2-L2-VH3-L3-VL3-L4-VH2-L5-VH1-Fc;

VL1-L1-VL2-L2-VH3-L3-VL3-L4-VH2-L5-VH1-L6-Fc;

VH1-L1-VH2-L2-VL3-L3-VH3-L4-VL2-L5-VL1-Fc;

VH1-L1-VH2-L2-VL3-L3-VH3-L4-VL2-L5-VL1-L6-Fc;

VL1-L1-VH2-L2-VH3-L3-VL3-L4-VL2-L5-VH1-Fc;

VL1-L1-VH2-L2-VH3-L3-VL3-L4-VL2-L5-VH1-L6-Fc;

VH1-L1-VL2-L2-VL3-L3-VH3-L4-VH2-L5-VL1-Fc; or
VH1-L1-VL2-L2-VL3-L3-VH3-L4-VH2-L5-VL1-L6-
  Fc;
the second polypeptide has a structure represented by:
VL4-VL5-Fc;
VL4-L7-VL5-Fc;
VL4-L7-VL5-L8-Fc;
VL4-CL-Fc;
VL4-L7-CL-Fc;
VL4-L7-CL-L8-Fc;
VL4-CH1-Fc;
VL4-L7-CH1-Fc;
VL4-L7-CH1-L8-Fc;
VH4-VH5-Fc;
VH4-L7-VH5-Fc;
VH4-L7-VH5-L8-Fc;
VH4-CL-Fc;
VH4-L7-CL-Fc;
VH4-L7-CL-L8-Fc;
VH4-CH1-Fc;
VH4-L7-CH1-Fc;
VH4-L7-CH1-L8-Fc;
VL4-VL5-VL6-Fc;
VL4-L7-VL5-L8-VL6-Fc;
VL4-L7-VL5-L8-VL6-L9-Fc;
VL4-VL5-VL6-CL-Fc;
VL4-L7-VL5-L8-VL6-CL-Fc;
VL4-L7-VL5-L8-VL6-L9-CL-Fc;
VL4-L7-VL5-L8-VL6-L9-CL-L10-Fc;
VL4-VL5-VL6-CH1-Fc;
VL4-L7-VL5-L8-VL6-CH1-Fc;
VL4-L7-VL5-L8-VL6-L9-CH1-Fc;
VL4-L7-VL5-L8-VL6-L9-CH1-L10-Fc;
VH4-VH5-VH6-Fc;
VH4-L7-VH5-L8-VH6-Fc;
VH4-L7-VH5-L8-VH6-L9-Fc;
VH4-VH5-VH6-CL-Fc;
VH4-L7-VH5-L8-VH6-CL-Fc;
VH4-L7-VH5-L8-VH6-L9-CL-Fc;
VH4-L7-VH5-L8-VH6-L9-CL-L10-Fc;
VH4-VH5-VH6-CH1-Fc;
VH4-L7-VH5-L8-VH6-CH1-Fc;
VH4-L7-VH5-L8-VH6-L9-CH1-Fc; or
VH4-L7-VH5-L8-VH6-L9-CH1-L10-Fc;
and the third polypeptide has a structure represented by:
VH4-VH5;
VH4-L11-VH5;
VH4-CH1;
VH4-L11-CH1;
VH4-CL;
VH4-L11-CL;
VH4-VH5;
VH4-L11-VH5;
VH4-VH5-VH6;
VH4-L11-VH5-L12-VH6;
VH4-VH5-VH6-CH1;
VH4-L11-VH5-L12-VH6-CH1;
VH4-L11-VH5-L12-VH6-L13-CH1;
VH4-VH5-VH6-CL;
VH4-L11-VH5-L12-VH6-CL;
VH4-L11-VH5-L12-VH6-L13-CL;
VL4-VL5-VL6;
VL4-L11-VL5-L12-VL6;
VL4-VL5-VL6-CH1;
VL4-L11-VL5-L12-VL6-CH1;
VL4-L11-VL5-L12-VL6-L13-CH1;
VL4-VL5-VL6-CL;

VL4-L11-VL5-L12-VL6-CL; or
VL4-L11-VL5-L12-VL6-L13-CL;
wherein:
VL1 is a first immunoglobulin light chain variable region;
VL2 is a second immunoglobulin light chain variable region;
VL3 is a third immunoglobulin light chain variable region;
VL4 is a fourth immunoglobulin light chain variable region;
VL5 is a fifth immunoglobulin light chain variable region;
VL6 is a sixth immunoglobulin light chain variable region;
VH1 is a first immunoglobulin heavy chain variable region;
VH2 is a second immunoglobulin heavy chain variable region;
VH3 is a third immunoglobulin heavy chain variable region;
VH4 is a fourth immunoglobulin heavy chain variable region;
VH5 is a fifth immunoglobulin heavy chain variable region;
VH6 is a sixth immunoglobulin heavy chain variable region;
Fc is a region comprising an immunoglobulin heavy chain constant region 2 (CH2), an immunoglobulin heavy chain constant region 3 (CH3), and optionally, an immunoglobulin hinge;
CH1 is a heavy chain constant region 1; CL is a light chain constant region; and L1, L2, L3, L4, L5, L6, L7, L8, L9, L10, L11, L12 and L13 are amino acid linkers.
8. The antigen binding polypeptide of any one of clauses 1-5 or the antigen binding polypeptide complex of clause 6 or clause 7, wherein VL1, VL2, VL3, VH1, VH2 and/or VH3 specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A;
optionally wherein VL1, VL2, VL3, VL4, VL5, VL6, VH1, VH2, VH3, VH4, VH5 and/or VH6 specifically binds to at least one epitope on at least one antigen selected from the group consisting of A2AR, APRIL, ATPDase, BAFF, BAFFR, BCMA, BlyS, BTK, BTLA, B7DC, B7H1, B7H2, B7H3, B7H4, B7H5, B7H6, B7H7, B7RP1, B7-4, C3, C5, CCL2, CCL3, CCL4, CCL5, CCL7, CCL8, CCL11, CCL15, CCL17, CCL19, CCL20, CCL21, CCL25 CCR3, CCR4, CD3, CD19, CD20, CD24, CD27, CD28, CD38, CD39, CD40, CD40L, CD47, CD52, CD70, CD80, CD86, CD123, CD133, CD137, CD137L, CD160, CD272, CEACAM5, CLEC9, CLEC91, CRTH2, CSF-1, CSF-2, CSF-3, CXCL1, CXCL2, CXCL4, CXCL12, CXCL13, CXCR3, cMet, CTLA4, DLL3, DNGR-1, E-cadherin, EGFR, ENTPD1, EpCAM, FCER1, FCER1A, FCER2, FGFR, FLAP, FOLH1, Gi24, GITR, GITRL, GPR5, HER2, HER3, ICOSL, ICOS, HHLA2, HMGB1, HVEM, IDO, IFNa, IgE, IGF1R, IL2Rbeta, IL1, ILIA, IL1B, IL1F10, IL2, IL4, IL4Ra, IL5, IL5R, IL6, IL7, IL7Ra, IL8, IL9, IL9R, IL10, rhIL1O, IL12, IL13, IL13Ra1, IL13Ra2, IL15, IL17, IL17Rb, IL18, IL22, IL23, IL25, IL7, IL33, IL35, ITGB4, ITK, KIR, LAG3, LAMP1, leptin, LPFS2, MHC class II, MUC-1, MUC-16, NCR3LG1, NKG2D, NKp46, NTPDase-1, OX40, OX40L, PD-1, PD-L1, PD-L2, PROM1, S152, SIRPalpha, SISP1, SLC, SPG64, ST2, STEAP1, STEAP2, Syk kinase, STEAP1, TROP2, TACI, TDO, T14, TIGIT, TIM3, TLR, TLR2, TLR4, TLR5, TLR9, TMEF1, TNFa, TNFRSF7, Tp55, TREM1, TSLP, TSLPR, TWEAK, VEGF, VISTA, Vstm3, WUCAM, DLL4, TGFbeta, GP100, GPRC5D, CD30 and CD16A.

9. The antigen binding polypeptide of any one of clauses 1-5 or the antigen binding polypeptide complex of clause 6 or clause 7, which specifically binds to a viral peptide, protein, polypeptide, or a fragment thereof, optionally wherein the VL1, VL2, VL3, VH1, VH2, and/or VH3 specifically binds to at least one epitope on at least one antigen of a viral peptide, protein, polypeptide, or a fragment thereof.

10. The antigen binding polypeptide complex of clause 9, wherein the viral peptide, protein, polypeptide, or a fragment is from: influenza virus neuraminidase, influenza virus hemagglutinin, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *chlamydia* MOMP and PorB antigens, core protein, matrix protein or other protein of Dengue virus, measles virus hemagglutinin, herpes simplex virus type 2 glycoprotein gB, poliovirus 1 VP1, envelope glycoproteins of HIV 1, hepatitis B surface antigen, diptheria toxin, streptococcus 24M epitope, gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, foot and mouth disease virus, hog colera virus, swine influenza virus, African swine fever virus, Mycoplasma liyopneutiioniae, infectious bovine rhinotracheitis virus, infectious bovine rhinotracheitis virus glycoprotein E, glycoprotein G, infectious laryngotracheitis virus, infectious laryngotracheitis virus glycoprotein G or glycoprotein I, a glycoprotein of La Crosse virus, neonatal calf diarrhoea virus, Venezuelan equine encephalomyelitis virus, punta toro virus, murine leukemia virus, mouse mammary tumor virus, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine E viral diarrhoea virus glycoprotein 48 and glycoprotein 53, glycoprotein E of Dengue virus, or glycoprotein E1E2 of human hepatitis C virus.

11. The antigen binding polypeptide of any one of clauses 1-5 or the antigen binding polypeptide complex of clause 6 or clause 7, wherein VL1, VL2, VL3, VH1, VH2, and/or VH3 specifically binds to an HIV protein; optionally wherein VL1, VL2, VL3, VL4, VL5, VL6, VH1, VH2, VH3, VH4, VH5 and/or VH6 specifically binds to an HIV protein.

12. The antigen binding polypeptide or antigen binding polypeptide complex of clause 11, wherein VH1, VH2, VH3 and VH4 specifically bind to different HIV proteins or to different epitopes on the same HIV protein.

13. The antigen binding polypeptide or antigen binding polypeptide complex of clause 11 or clause 12, wherein VH1, VH2, VH3, VH4 and VH5 specifically bind to different HIV proteins or to different epitopes on the same HIV protein.

14. The antigen binding polypeptide or antigen binding polypeptide complex of any one of clauses 11-13, wherein VH1, VH2, VH3, VH4, VH5 and VH6 specifically bind to different HIV proteins or to different epitopes on the same HIV protein.

15. The antigen binding polypeptide or antigen binding polypeptide complex of any one of clauses 11-14, wherein VL1, VL2, VL3 and VL4 specifically bind to different HIV proteins or to different epitopes on the same HIV protein.

16. The antigen binding polypeptide complex of any one of clauses 11-15, wherein VL1, VL2, VL3, VL4 and VL5 specifically bind to different HIV proteins or to different epitopes on the same HIV protein.

17. The antigen binding polypeptide or antigen binding polypeptide complex of any one of clauses 11-16, wherein VL1, VL2, VL3, VL4, VL5 and VL6 specifically bind to different HIV proteins or to different epitopes on the same HIV protein.

18. The antigen binding polypeptide or antigen binding polypeptide complex of any one of clauses 11-17, wherein VH1, VL1, VH4 and VL4 specifically bind to the same HIV protein; VH2, VL2, VH5 and VL5 specifically bind to the same HIV protein; and VH3, VL3, VH6 and VL6 specifically bind to the same HIV protein.

19. The antigen binding polypeptide or antigen binding polypeptide complex of any one of claims 11-18, wherein the HIV protein is an HIV envelope protein, an HIV structural protein, an HIV functional protein, or an HIV accessory protein.

20. The antigen binding polypeptide or antigen binding polypeptide complex of clause 19, wherein the HIV envelope protein is HIV envelope glycoprotein (Env), HIV envelope glycoprotein gp160, HIV envelope surface glycoprotein gp120, or HIV transmembrane envelope protein gp41.

21. The antigen binding polypeptide or antigen binding polypeptide complex of clause 19, wherein the HIV structural protein is p17, p24, p7 or p55.

22. The antigen binding polypeptide or antigen binding polypeptide complex of clause 19, wherein the HIV functional protein is p66, HIV-1 protease (PR) or p31.

23. The antigen binding polypeptide or antigen binding polypeptide complex of clause 19, wherein the HIV accessory protein is Nef, Tat, Rev, Vif, Vpr or Vpu.

24. The antigen binding polypeptide or antigen binding polypeptide complex of any one of clauses 19-23, wherein VH1, VH2, VH3, VL1, VL2 and/or VL3 specifically binds to at least one epitope on at least one antigen selected from the group consisting of Env, gp160, gp120, gp41, p17, p24, p7, p55, p66, p31, Nef, Tat, Rev, Vif, Vpr and Vpu; optionally wherein VH1, VH2, VH3, VH4, VH5, VH6, VL1, VL2, VL3, VL4, VL5 and/or VL6 specifically binds to at least one epitope on at least one antigen selected from the group consisting of Env, gp160, gp120, gp41, p17, p24, p7, p55, p66, p31, Nef, Tat, Rev, Vif, Vpr and Vpu.

25. The antigen binding polypeptide or antigen binding polypeptide complex of any one of clauses 11-24, wherein one or more of VH1, VH2, and VH3 comprises an amino acid sequence having at least 80%, at least 85%, at least 90%, at least 95%, at least 96%, at least 97%, at least 98%, at least 99%, or 100% identity to any one of SEQ ID NOs:349-352; optionally wherein one or more of VH1, VH2, VH3, VH4, VH5 and VH6 comprises an amino acid sequence having at least 80%, at least 85%, at least 90%, at least 95%, at least 96%, at least 97%, at least 98%, at least 99%, or 100% identity to any one of SEQ ID NOs:349-352.

26. The antigen binding polypeptide or antigen binding polypeptide complex of any one of clauses 11-25, wherein one or more of VL1, VL2, and VL3 comprises an amino acid sequence having at least 80%, at least 85%, at least 90%, at least 95%, at least 96%, at least 97%, at least 98%, at least 99%, or 100% identity to any one of SEQ ID NOs:353-356; optionally wherein one or more of VL1, VL2, VL3, VL4, VL5 and VL6 comprises an amino acid sequence having at least 80%, at least 85%, at least 90%, at least 95%, at least 96%, at least 97%, at least 98%, at least 99%, or 100% identity to any one of SEQ ID NOs:353-356.

27. The antigen binding polypeptide or antigen binding polypeptide complex of any one of clauses 1-26, wherein VH1, VL1, VH4 and VL4 specifically bind to the same antigen; VH2, VL2, VH5 and VL5 specifically bind to the same antigen; and VH3, VL3, VH6 and VL6 specifically bind to the same antigen.

28. The antigen binding polypeptide or antigen binding polypeptide complex of any one of clauses 1-26, wherein VL1, VL2, VL3 and VL4 specifically bind to different antigens.

29. The antigen binding polypeptide or antigen binding polypeptide complex of any one of clauses 1-26, wherein VL1, VL2, VL3, VL4 and VL5 specifically bind to different antigens.

30. The antigen binding polypeptide or antigen binding polypeptide complex of any one of clauses 1-26, wherein VL1, VL2, VL3, VL4, VL5 and VL6 specifically bind to different antigens.

31. The antigen binding polypeptide or antigen binding polypeptide complex of any one of clauses 1-30, wherein the immunoglobulin hinge comprises an upper hinge region, a middle hinge region, a lower hinge region, or a combination thereof.

32. The antigen binding polypeptide or antigen binding polypeptide complex of any one of clauses 1-31, wherein linkers L1, L2, L3, L4, L5, L6, L7, L8, L9, L10, L11, L12 and/or L13 have a length of from about 1 amino acid to about 50 amino acids.

33. The antigen binding polypeptide or antigen binding polypeptide complex of any one of clauses 1-32, wherein linkers L1, L2, L3, L4, L5, L6, L7, L8, L9, L10, L11, L12 and/or L13 comprise the amino acid sequence of g, a, gss, asg, ggssg, gssgs, gtvaa, asggs, astgg, asggsg, ggsggssgss, sggsgssggs, ggsggsgsgggsasgsg, ggsggsgsgggsasgsg, gggssgggsgggsgssgs, ggggsggsgsgggsasgsg, gggssggsgsgggsgssgs, sggssggsgsgggsgggsgssg, gsgssgggsgggsgsgggssg, ggggsgsggsggsgggsggggsgggsgggsgggsggggs, ggggsgggsgggsgggsgggsgggsgggsggggsggggs, ggggsgsggsggssgggsgggsgggsgggsgggsggggsss, ggggsgsggsggssgggsgggsgggsgggsgggsggggsssgs, ggsgg, gsggsagsgsggggsasgsg, ggggs, or gsggsgggsgsggggsasgsg (SEQ ID NOs:1-19 and 679-686) or a sequence having at least 50%, at least 60%, at least 70%, at least 80%, at least 90%, or at least 95% identity to any one of SEQ ID NOs:1-19 and 679-686.

34. The antigen binding polypeptide or antigen binding polypeptide complex of any one of clauses 1-33, wherein the amino acid linkers are non-immunogenic.

35. The antigen binding polypeptide or antigen binding polypeptide complex of any one of clauses 1-34, wherein the amino acid linkers do not contain a consensus T cell epitope.

36. The antigen binding polypeptide or antigen binding polypeptide complex of any one of clauses 1-35, wherein the Fc region comprises at least one knob-into-hole modification.

37. The antigen binding polypeptide complex of clause 36, wherein the antigen binding polypeptide complex is an IgG1 or IgG4 antibody and the knob-into-hole modification comprises:
    (i) knob substitutions of S354C and T366W and hole substitutions of Y349C, T366S, L368A and Y407V;
    (ii) hole substitutions of L234A, L235A and P239A;
    (iii) hole substitutions of L234A and L235A;
    (iv) hole substitutions of M428L and N433S;
    (v) hole substitutions of M252Y, S254T and T256E; or
    (vi) a combination thereof;
    based on the EU numbering scheme.

38. The antigen binding polypeptide or antigen binding polypeptide complex of any one of clauses 1-37, wherein the antigen binding polypeptide or antigen binding polypeptide complex comprises a detectable label.

39. The antigen binding polypeptide or antigen binding polypeptide complex of clause 38, wherein the detectable label is a radioactive label, chemiluminescent label, fluorescent label, enzyme, or peptide tag, or a combination thereof.

40. The antigen binding polypeptide or antigen binding polypeptide complex of clause 39, wherein the peptide tag is a polyhistidine tag consisting of from about 4 to about 10 histidine residues.

41. The antigen binding polypeptide or antigen binding polypeptide complex of clause 40, wherein the polyhistidine tag consists of about 8 histidine residues.

42. The antigen binding polypeptide or antigen binding polypeptide complex of any one of clauses 1-41, wherein the antigen binding polypeptide or antigen binding polypeptide complex is conjugated to an agent as an antibody-drug conjugate (ADC).

43. The antigen binding polypeptide or antigen binding polypeptide complex of clause 42, wherein the agent is a cytotoxic agent, immunomodulating agent, imaging agent, or therapeutic protein, or a combination thereof.

44. The antigen binding polypeptide or antigen binding polypeptide complex of any one of clauses 1-43 that binds to an antigen with an equilibrium dissociation constant ($K_D$) of from about 10 μM to about 1 pM.

45. The antigen binding polypeptide or antigen binding polypeptide complex of any one of clauses 1-44, further comprising an effector function mutation.

46. An antibody or antigen binding fragment thereof comprising the antigen binding polypeptide or antigen binding polypeptide complex of any one of clauses 1-45.

47. The antibody or antigen binding fragment thereof of clause 46, wherein the antibody is IgG, IgM, IgE, IgA or IgD.

48. The antibody or antigen binding fragment thereof of clause 47, wherein the IgG is IgG1, IgG2, IgG3 or IgG4.

49. The antibody or antigen binding fragment thereof of clause 46, wherein the antigen binding fragment is a Fab, scFab, Fab', F(ab')$_2$, Fv, or scFv.

50. The antibody or antigen binding fragment thereof of clause 46, wherein the antibody is human or humanized 51. A chimeric antigen receptor (CAR) comprising the antigen binding polypeptide or antigen binding polypeptide complex of any one of clauses 1-45.

52. An immune cell comprising the CAR of clause 51.

53. A pharmaceutical composition comprising (i) the antigen binding polypeptide or antigen binding polypeptide complex of any one of clauses 1-45, the antibody or antigen binding fragment thereof of any one of clauses 46-50, the CAR of clause 51, the immune cell of clause 52, or a combination thereof, and (ii) a pharmaceutically acceptable carrier.

54. A kit comprising the antigen binding polypeptide or antigen binding polypeptide complex of any one of clauses 1-45, the antibody or antigen binding fragment thereof of any one of clauses 46-50, the CAR of clause 51, the immune cell of clause 52, the pharmaceutical composition of clause 53, or a combination thereof.

55. An antigen binding polypeptide or antigen binding polypeptide complex according to any one of clauses 1-45, an antibody or antigen binding fragment according to any one of clauses 46-50, a CAR according to clause 51, an immune cell according to clause 52, a pharmaceutical composition according to clause 53, or a combination thereof, for use in treating or preventing a disease in a subject in need thereof.

56. The antigen binding polypeptide, antigen binding polypeptide complex, antibody or antigen binding fragment, CAR, immune cell or pharmaceutical composition for use according to clause 55, wherein the disease is human immunodeficiency virus (HIV) infection, acquired immune deficiency syndrome (AIDS), AIDS-related complex (ARC), or HIV-related opportunistic infection, optionally wherein the antigen binding polypeptide or antigen binding polypeptide complex is as defined in any one of clauses 11-26.

57. The antigen binding polypeptide, antigen binding polypeptide complex, antibody or antigen binding fragment, CAR, immune cell or pharmaceutical composition for use according to clause 56, wherein the HIV is HIV-1.

58. The antigen binding polypeptide, antigen binding polypeptide complex, antibody or antigen binding fragment, CAR, immune cell or pharmaceutical composition for use according to clause 55, wherein the disease is cancer, optionally wherein the antigen binding polypeptide or antigen binding polypeptide complex is as defined in clause 8.

59. An antigen binding polypeptide or antigen binding polypeptide complex according to any one of clauses 1-45, an antibody or antigen binding fragment according to any one of clauses 46-50, a CAR according to clause 51, an immune cell according to clause 52, a pharmaceutical composition according to clause 53, or a combination thereof, for use in treating or preventing a virus infection, optionally wherein the virus is influenza virus, respiratory syncytial virus (RSV), *chlamydia*, adenovirdiae, mastadeno virus, aviadenovirus, herpesviridae, herpes simplex virus 1, herpes simplex virus 2, herpes simplex virus 5, herpes simplex virus 6, leviviridae, levivirus, enterobacteria phase MS2, allolevirus, poxviridae, chordopoxvirinae, parapoxvirus, avipoxvirus, capripoxvirus, leporiipoxvirus, suipoxvirus, molluscipoxvirus, entomopoxvirinae, papovaviridae, polyomavirus, papillomavirus, paramyxoviridae, paramyxovirus, parainfluenza virus 1, mobillivirus, measles virus, rubulavirus, mumps virus, pneumonovirinae, pneumovirus, me tapneumo virus, avian pneumovirus, human metapneumovirus, picornaviridae, enterovirus, rhinovirus, hepatovirus, human hepatitis A virus, cardiovirus, andaptho virus, reoviridae, orthoreovirus, orbivirus, rotavirus, cypovirus, fijivirus, phytoreovirus, oryzavirus, retroviridae, mammalian type B retroviruses, mammalian type C retroviruses, avian type C retroviruses, type D retrovirus group, BLV-HTLV retroviruses, lentivirus, human immunodeficiency virus 1, human immunodeficiency virus 2, HTLV-I and -II viruses, SARS coronavirus, herpes simplex E virus, Epstein Barr virus, cytomegalovirus, hepatitis virus (HCV, HAV, HBV, HDV, HEV), *Toxoplasma gondii* virus, treponema pallidium virus, human T-lymphotrophic virus, encephalitis virus, West Nile virus, Dengue virus, Varicella Zoster Virus, rubeola, mumps, rubella, spumavirus, flaviviridae, hepatitis C virus, hepadnaviridae, hepatitis B virus, togaviridae, alphavirus sindbis virus, rubivirus, rubella virus, rhabdoviridae, vesiculovirus, lyssavirus, ephemerovirus, cytorhabdo virus, necleorhabdo virus, arenaviridae, arenavirus, lymphocytic choriomeningitis virus, Ippy virus, lassa virus, coronaviridae, coronavirus, or torovirus; and/or wherein the antigen binding polypeptide or antigen binding polypeptide complex is as defined in clause 9 or clause 10.

EXAMPLES

The following examples are provided to further illustrate aspects of the disclosure, and are not meant to constrain the disclosure to any particular application or theory of operation.

Example 1

Design of Trispecific Antibody Constructs

Non-limiting examples of multispecific antibody configurations are shown in FIGS. 1A-1E, 5, 7 and 9. Antibody heavy chain variable domains (VH) and light chain variable domains (VL) targeting human CD3, CD19, CD20, CD28 and CD38 were selected from publicly available databases (e.g., GenBank) or patents to illustrate the feasibility of constructing various formats of trispecific antibodies. Linkers in various length and sequence connecting VH and VL regions in different orders and orientations were tested, with and without different motifs of the constant domains (e.g., CL, CH1, CH2, CH3). "Knob" and "hole" mutations were integrated into respective halves of the antibody Fc region when Fc heterodimerization was needed. Effector function or half-life extension mutations can also be incorporated into the Fc sequences when needed. Once the amino acid sequences for each multispecific antibody molecule were assembled, DNA encoding these sequences was codon optimized, synthesized (Cambridge Biologics, LLC, Brookline, MA), and cloned into a eukaryotic expression vector.

Example 2

Multispecific Antibody Expression and Purification

Multispecific antibodies were produced by transient transfection of expression plasmids into Expi293F cells at density of 2.5-3.0×10⁶/ml using polyethylenimine (PEI; Poly science). Plasmid DNA and PEI were diluted in OPTi-MEM (LifeTech) separately and mixed later. The plasmid/PEI mixture, at a ratio of 1:3 (w:w), was added to the cell culture 10 minutes after mixing. Valproic acid and sodium propionate were added to final concentrations of 0.5 mM and 5 mM, respectively, 16-20 hours post transfection. Supernatant was harvested 5 days post transfection, and filtered through a 0.45 um filter. Multispecific antibodies were then purified first by affinity chromatography using Protein A resins in batch mode according to the manufacture's standard procedures. After antibodies were eluted using IgG elusion buffer (Thermo Fischer Scientific) from protein A, they were dialyzed into 10 mM Histidine (pH6.0)+25 mM NaCl overnight Antibodies were further purified by size exclusion chromatography using Hiload 16/600 Superdex 200 PG or Superdex 200 Increase 10/300 GL (Cytiva Lifesciences). Fractions with the correct elusion profile were collected and concentrated for further characterization.

Example 3

Multispecific Antibody ELISA Binding Analysis

An ELISA binding assay was used to test binding of multispecific antibodies to their target antigens. Target protein for each binding site of the multispecific antibodies was coated in the wells of 96-well Immuno Plates (Thermo Fisher Scientific) overnight at 4° C. Coated plates were blocked using 5% skim milk+2% bovine serum albumin (BSA) in phosphate buffered saline (PBS)+0.25% Tween for one hour at room temperature, then washed three times with PBS+0.25% Tween 20. Serial diluted multispecific antibodies and control molecules were added to the plate and incubated at room temperature for 1 hr. Plates were washed three times with PBS+0.25% Tween 20, incubated with horseradish peroxidase (HPR) conjugated detection antibody for one hour at room temperature, washed again, and then developed with Peroxidase Substrate (KPL, Gaithersburg, MD, USA). After the reaction was terminated by adding 100 µl of KPL TMB BlueSTOP solution, the plate was read at $OD_{650}$ using a plate reader and data analyzed in GraphPad Prism.

Figure 1C:
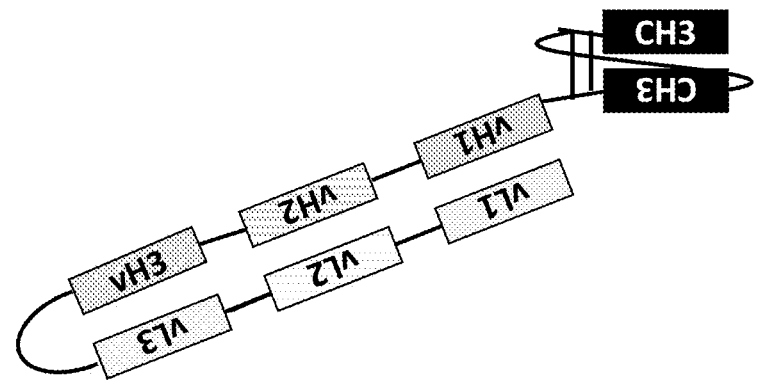
Figure 1B:
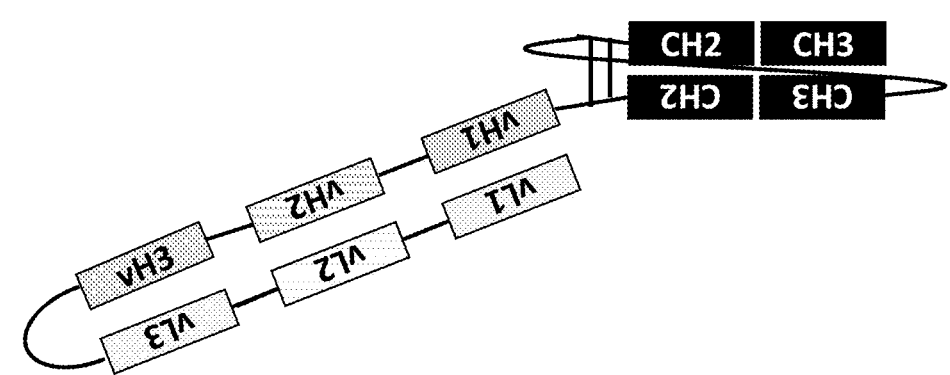
Figure 1D:
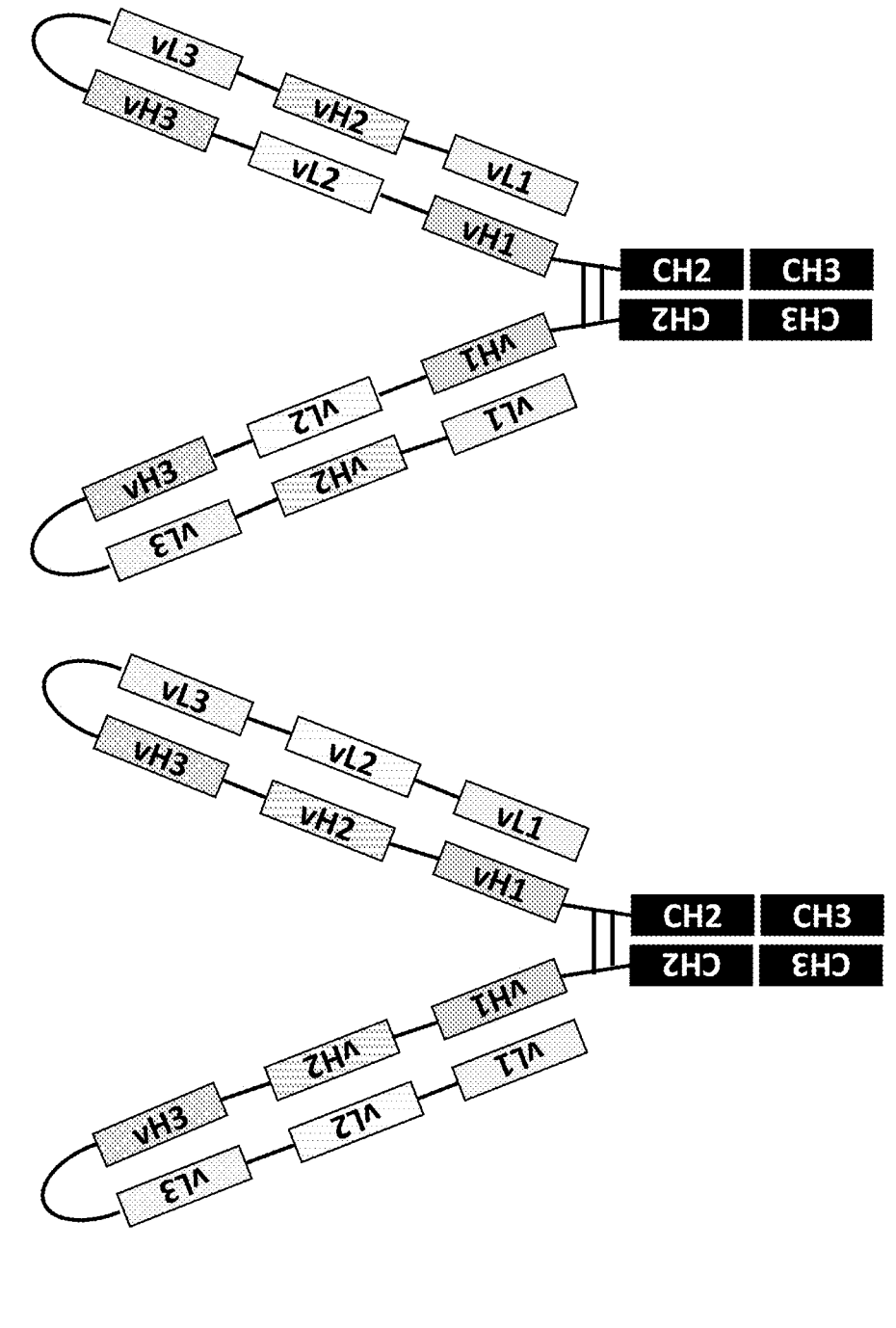
Figure 1E:
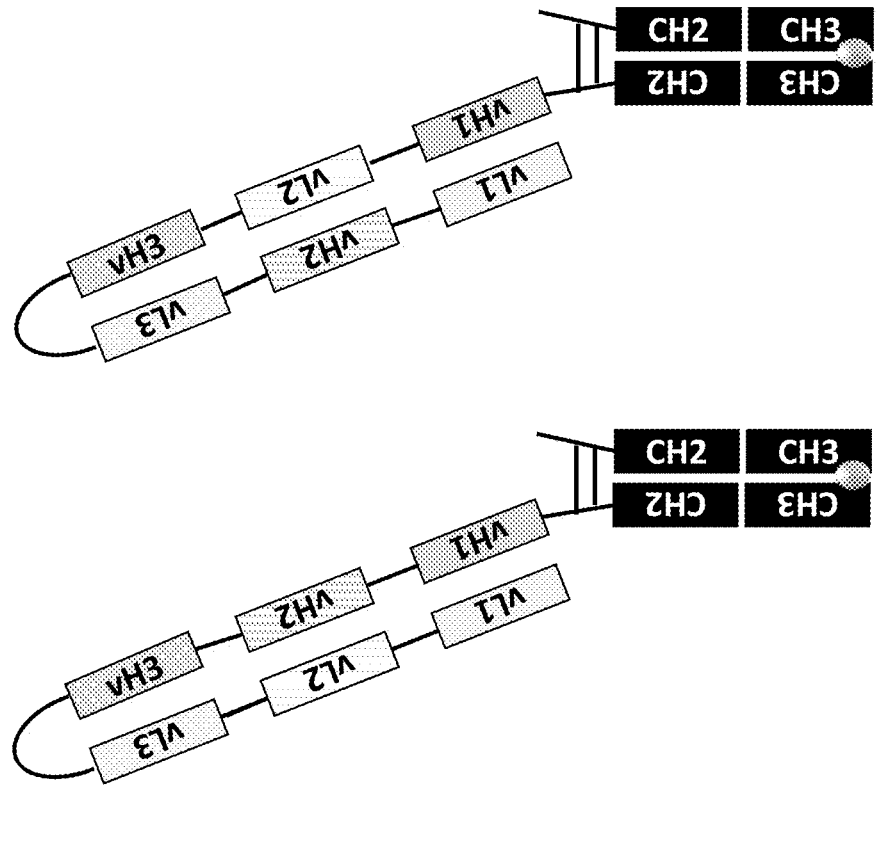
Figure 2A:
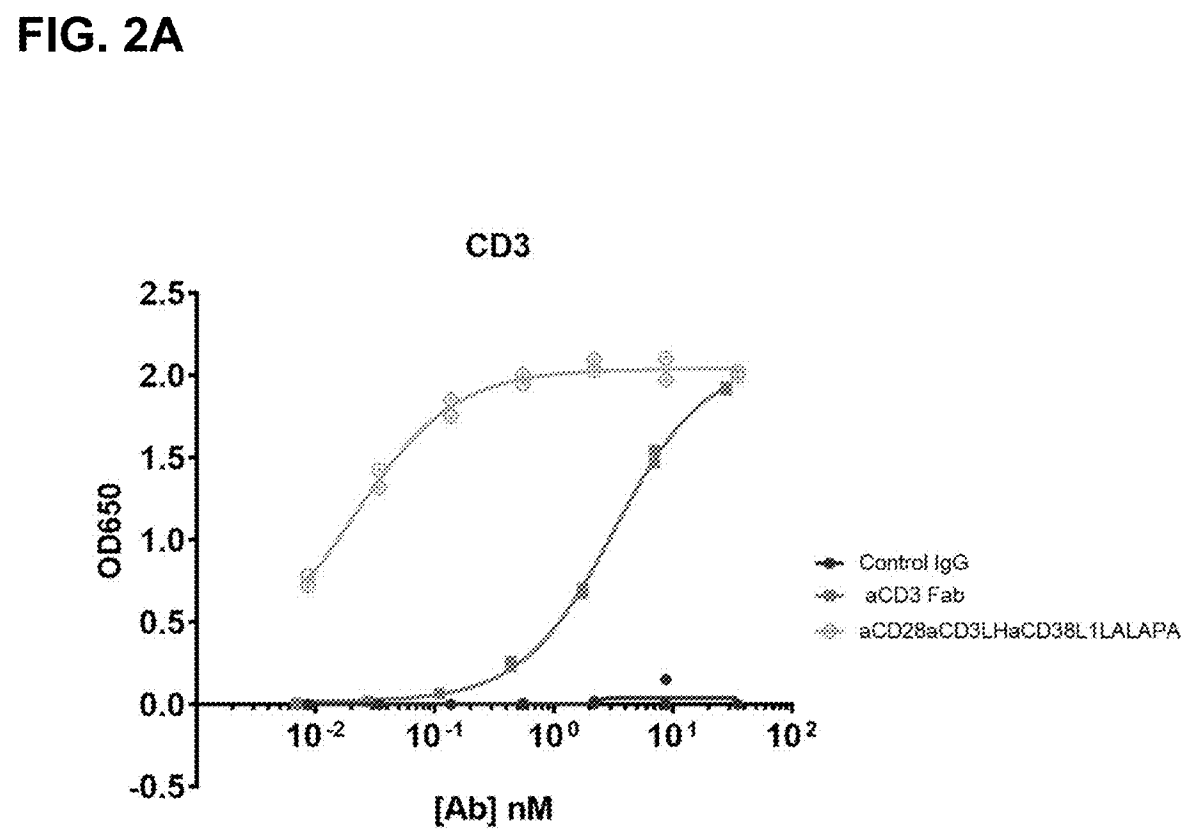
Figure 2B:
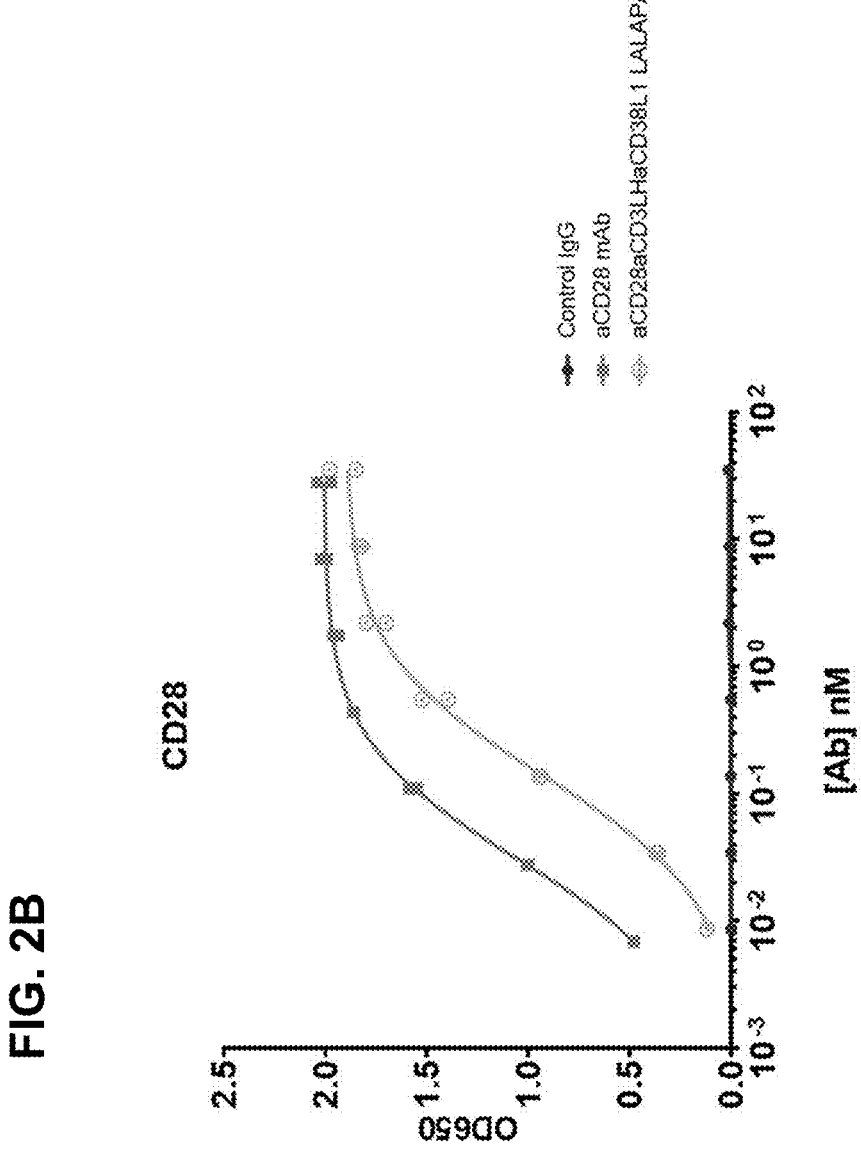
Figure 2C:
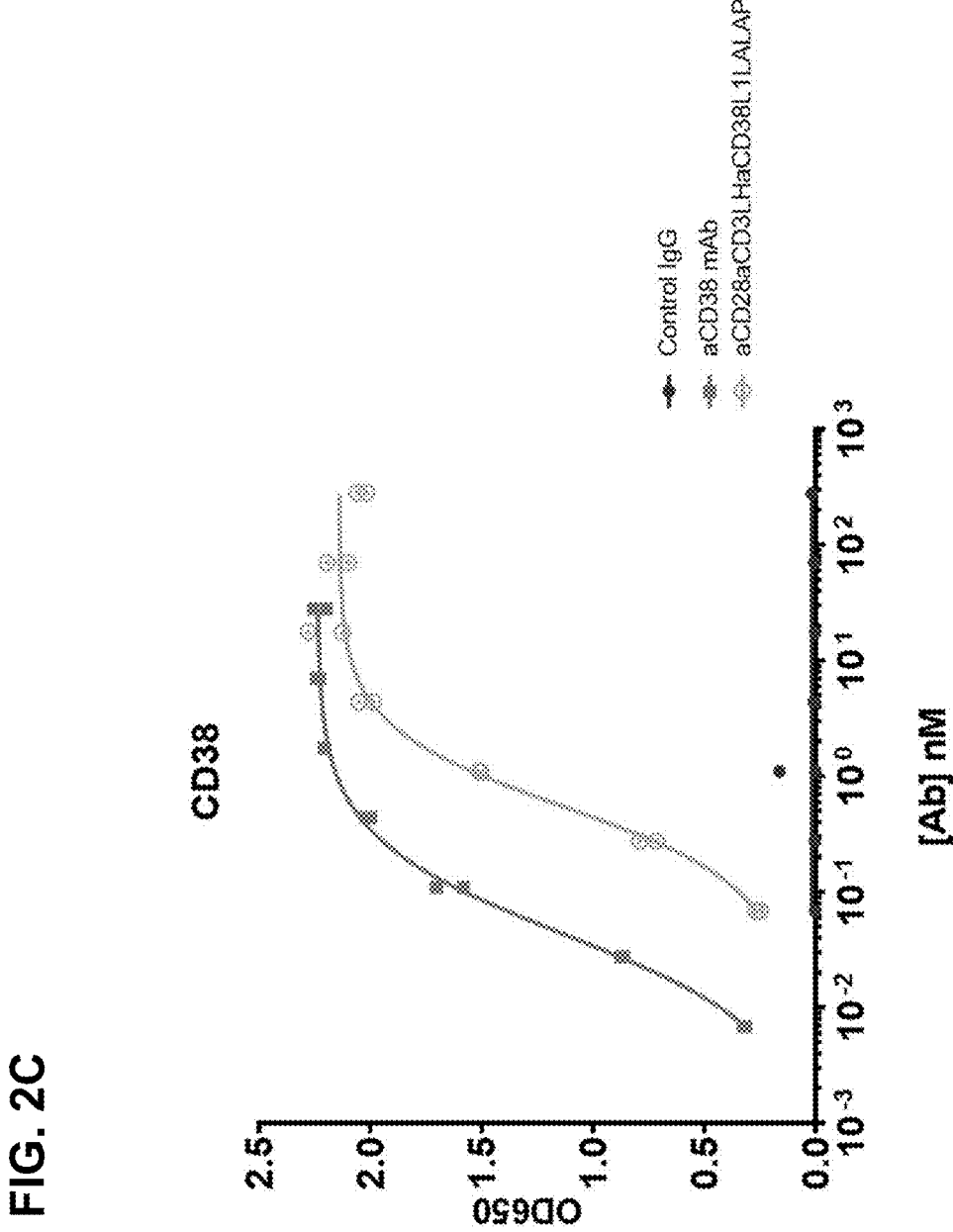

FIGS. 2A-2C show ELISA results of trispecific aCD28aCD3LHaCD38 LALAPAFc and respective positive controls, aCD28aCD3/aCD38Fab, or isotype control (Control IgG) binding to CD3 (FIG. 2A), CD28 (FIG. 2B), and CD38 (FIG. 2C).

Figure 3A:
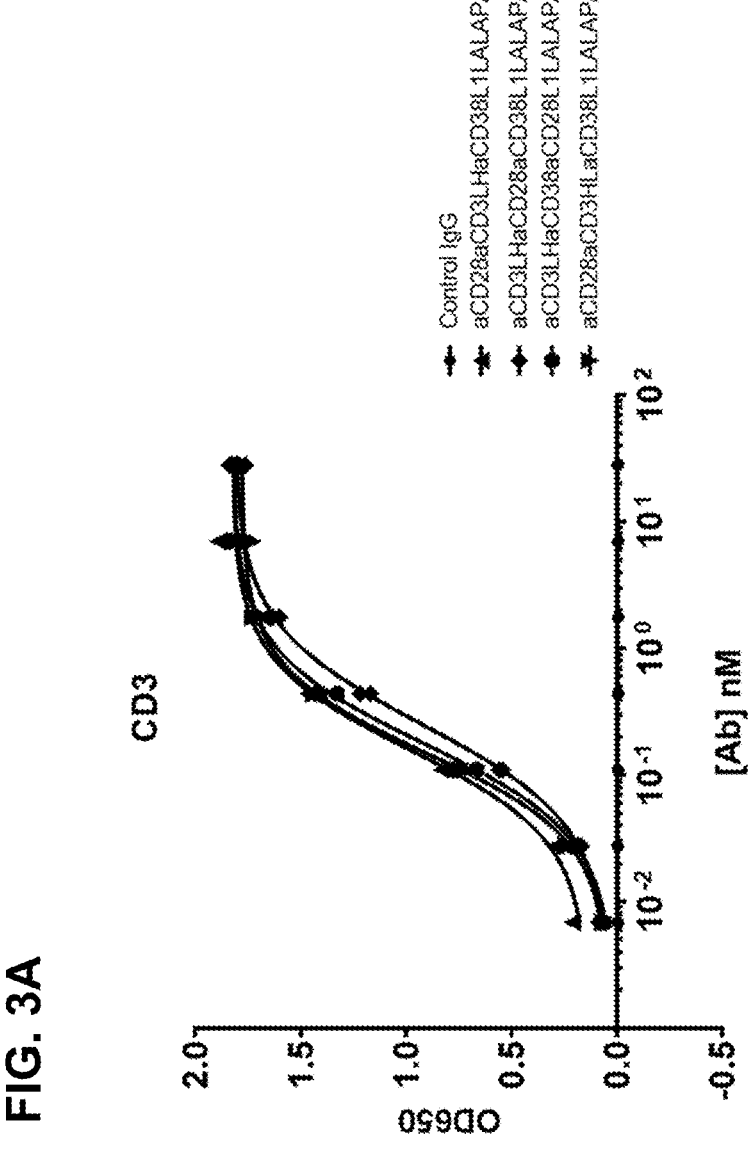
FIGS. 3A-3C show ELISA results of trispecific aCD28aCD3LHaCD38 LALAPAFc, aCD3LHaCD28aCD38 LALAPAFc, aCD3LHaCD38aCD28 LALAPAFc, aCD28aCD3HLaCD38 LALAPAFc, or isotype control (Control IgG) binding to CD3 (FIG. 3A), CD28 (FIG. 3B), and CD38 (FIG. 3C). Molecule structures are depicted in FIG. 1E.
Figure 3B:
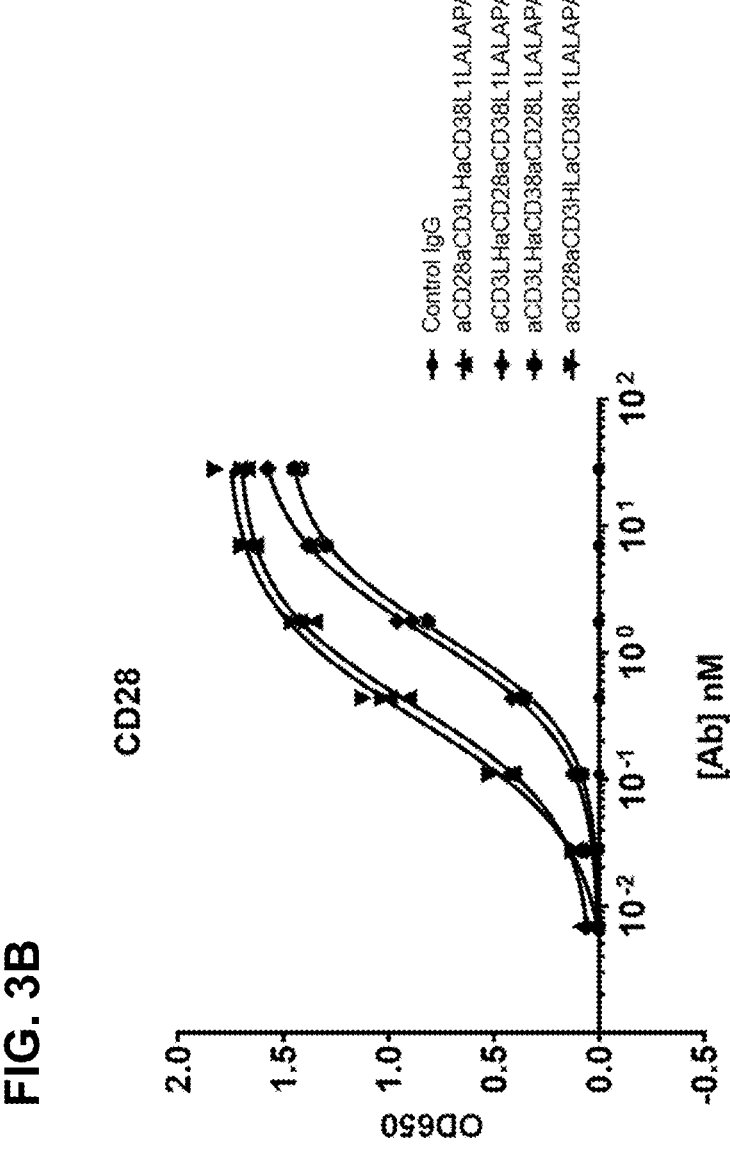
Figure 3C:
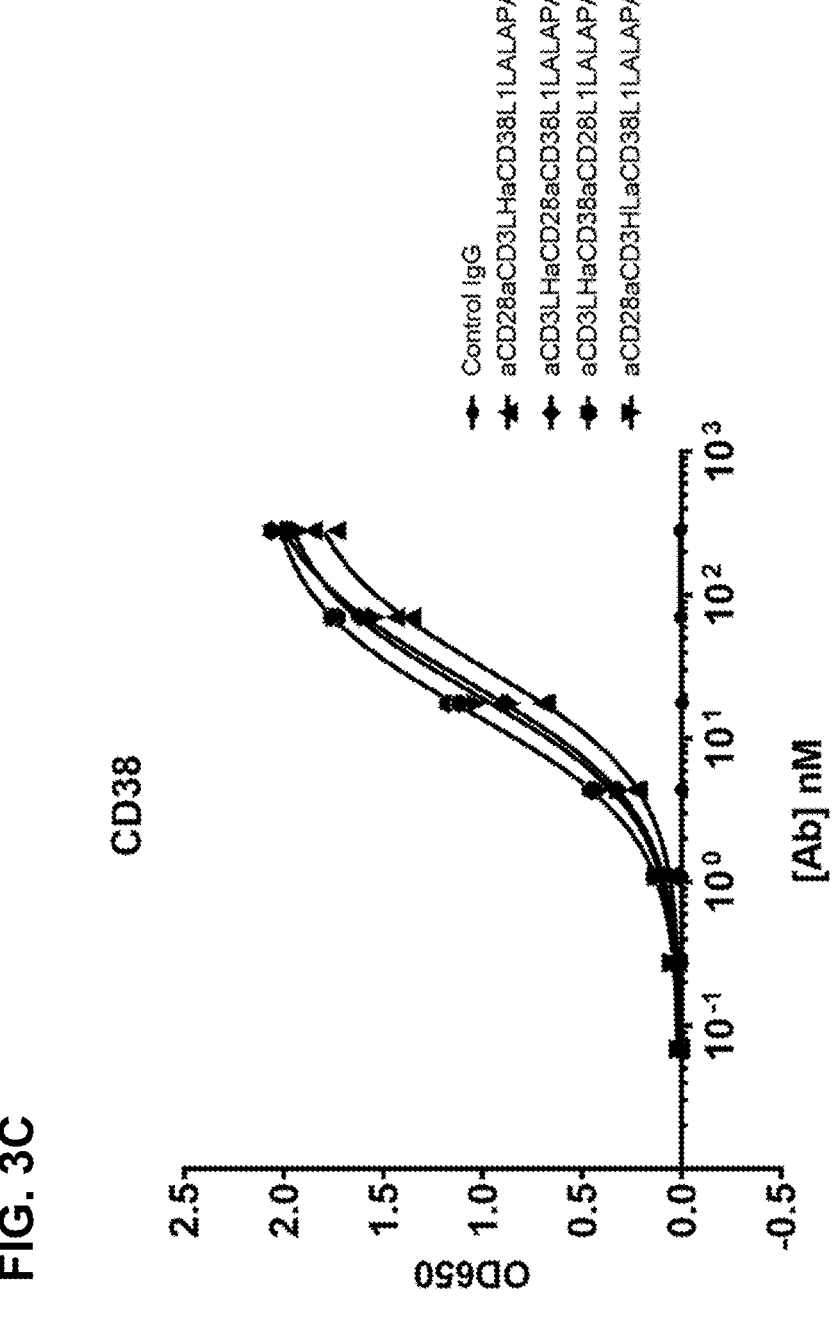

FIGS. 3A-3C show ELISA results of trispecific aCD28aCD3LHaCD38 LALAPAFc, aCD3LHaCD28aCD38 LALAPAFc, aCD3LHaCD38aCD28 LALAPAFc, aCD28aCD3HLaCD38 LALAPAFc, or isotype control (Control IgG) binding to CD3 (FIG. 3A), CD28 (FIG. 3B), and CD38 (FIG. 3C).

Figure 6A:
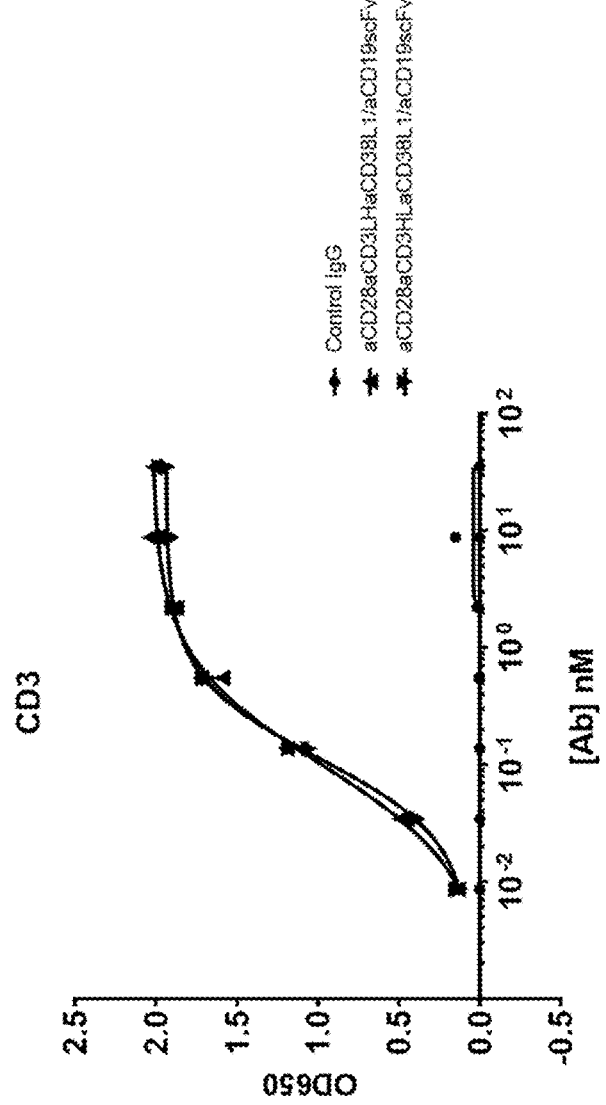
FIGS. 6A-6D show ELISA results of tetraspecific aCD28aCD3LHaCD38/aCD19 scFv, aCD28aCD3HLaCD38/aCD19scFv, or isotype control (Control IgG) binding to CD3 (FIG. 6A), CD28 (FIG. 6B), CD38 (FIG. 6C), and CD19 (FIG. 6D). Molecule structures are depicted in FIG. 5.
Figure 6B:
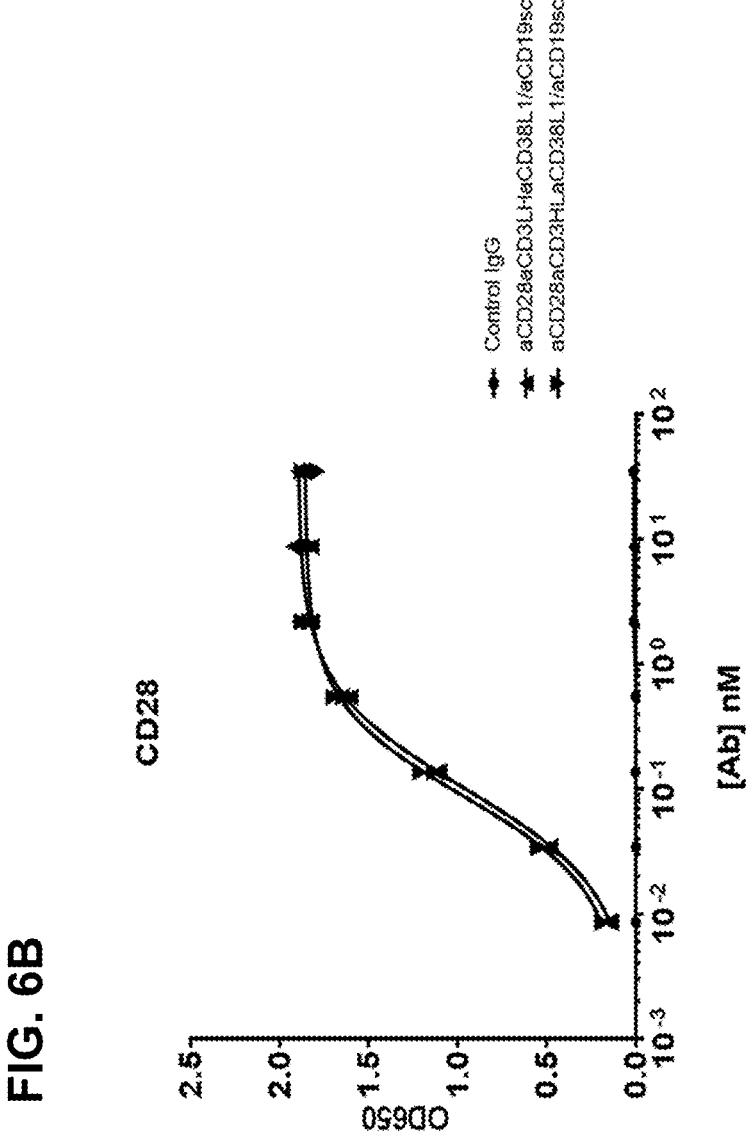
Figure 6C:
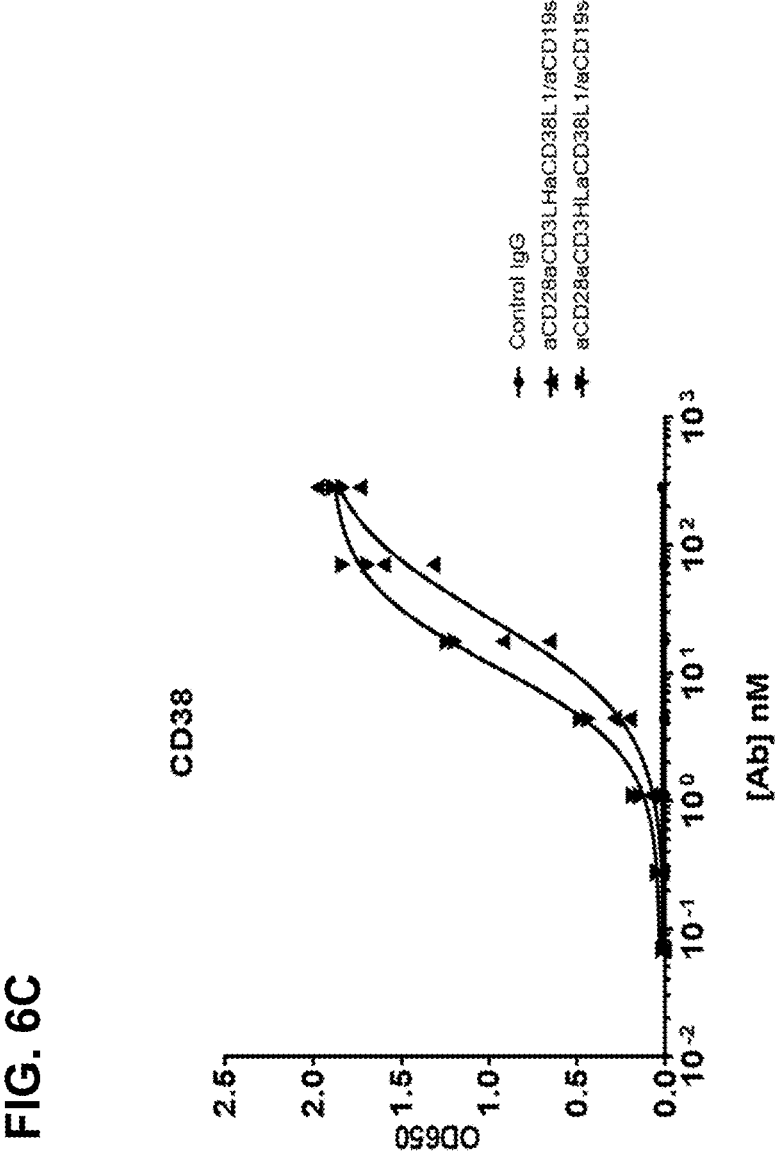
Figure 6D:
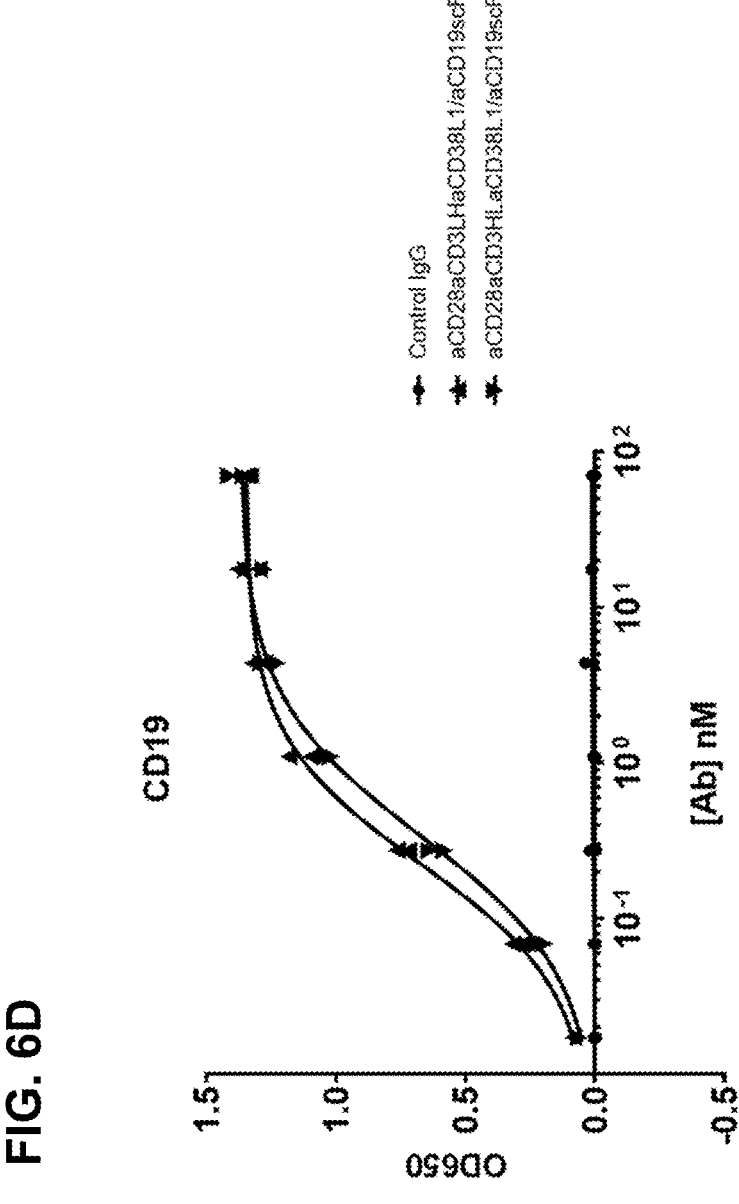
Figure 7:
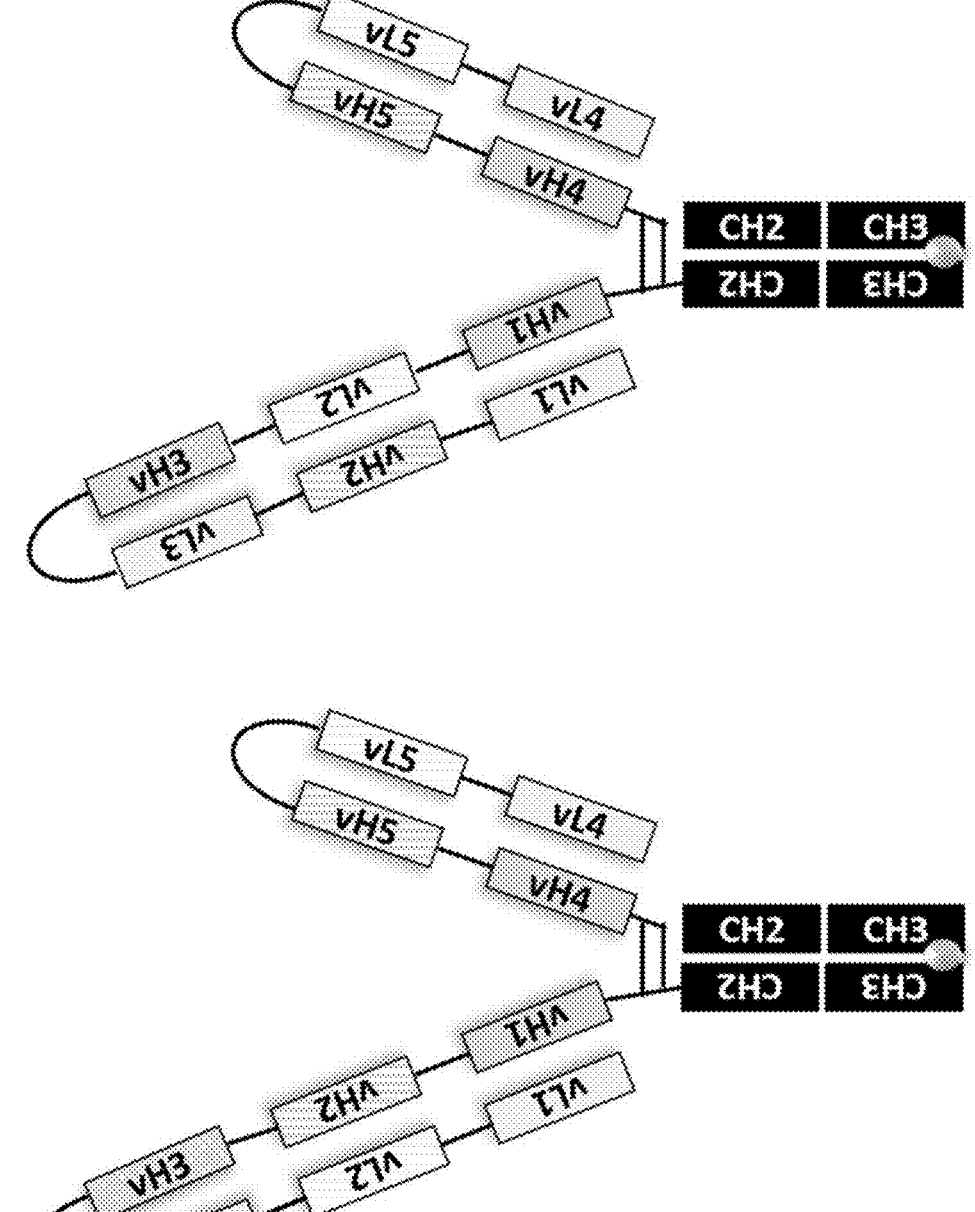
FIG. 7 shows non-limiting examples of different configurations of pentaspecific antibody molecules. As used in FIG. 7, vL1 is a first immunoglobulin light chain variable region. vL2 is a second immunoglobulin light chain variable region. vL3 is a third immunoglobulin light chain variable region. vL4 is a fourth immunoglobulin light chain variable region. vL5 is a fifth immunoglobulin light chain variable region. vH1 is a first immunoglobulin heavy chain variable region. vH2 is a second immunoglobulin heavy chain variable region. vH3 is a third immunoglobulin heavy chain variable region. vH4 is a fourth immunoglobulin heavy chain variable region. vH5 is a fifth immunoglobulin heavy chain variable region. CH2 is an immunoglobulin heavy chain constant region 2. CH3 is an immunoglobulin heavy chain constant region 3. The circle symbol in the CH3 region indicates a knob-into-hole modification.

FIGS. 6A-6D show ELISA results of tetraspecific aCD28aCD3LHaCD38/aCD19scFv, aCD28aCD3HLaCD38/aCD19scFv, or isotype control (Control IgG) binding to CD3 (FIG. 6A), CD28 (FIG. 6B), CD38 (FIG. 6C), and CD19 (FIG. 6D).

Figure 8A:
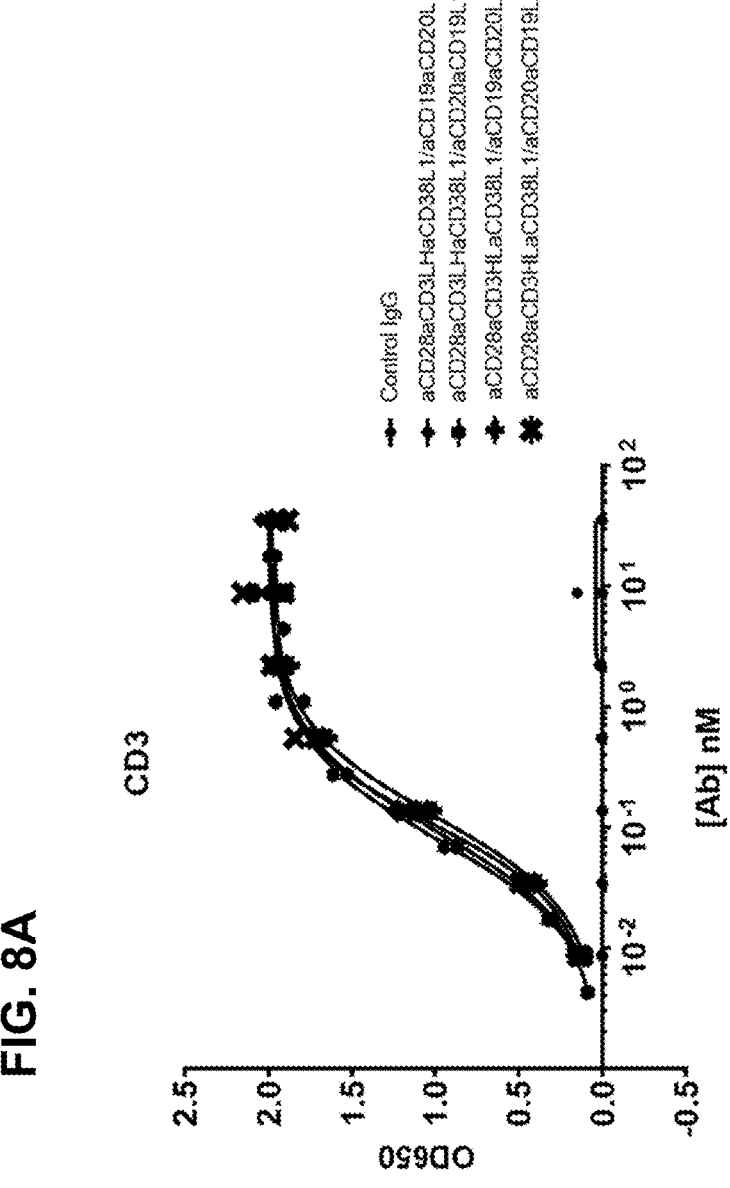
FIGS. 8A-8D show ELISA results of tetraspecific aCD28aCD3LHaCD38/aCD19aCD20, aCD28aCD3LHaCD38/aCD20aCD19, aCD28aCD3HLaCD38/aCD19aCD20, aCD28aCD3HLaCD38/aCD20aCD19, or isotype control (Control IgG) binding to CD3 (FIG. 8A), CD28 (FIG. 8B), CD38 (FIG. 8C), and CD19 (FIG. 8D). Molecule structures are depicted in FIG. 7.
Figure 8B:
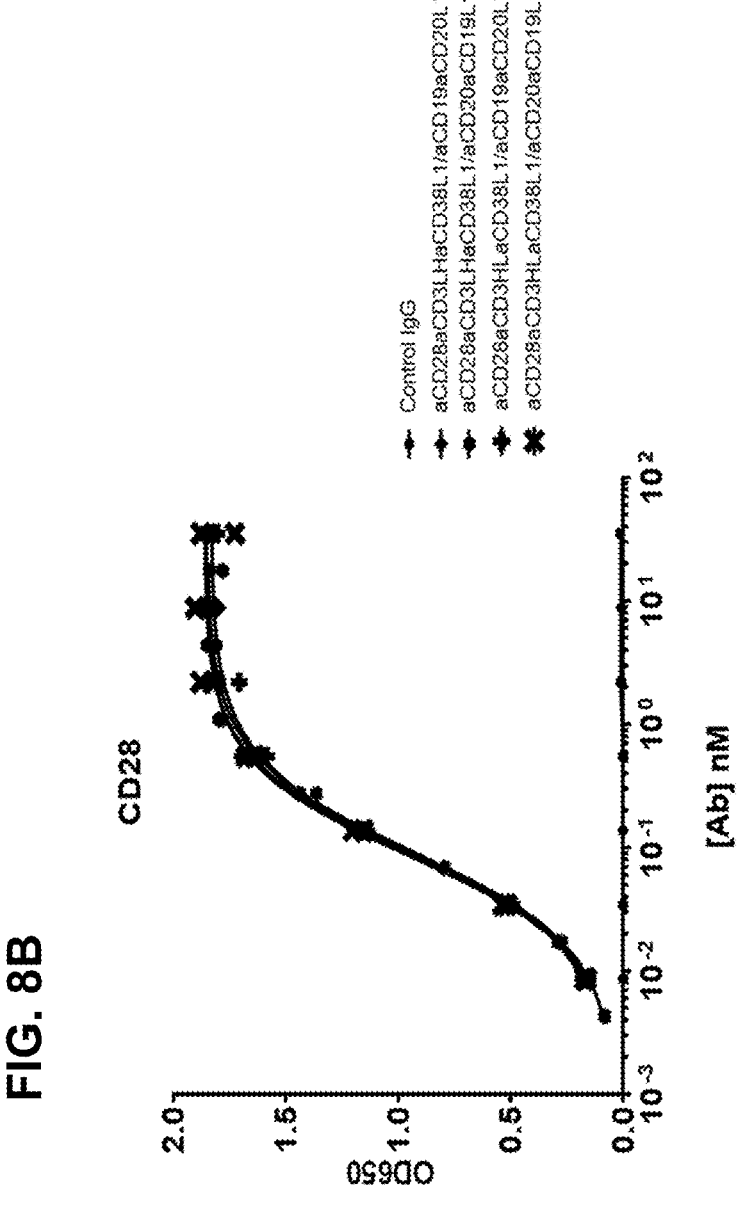
Figure 8C:
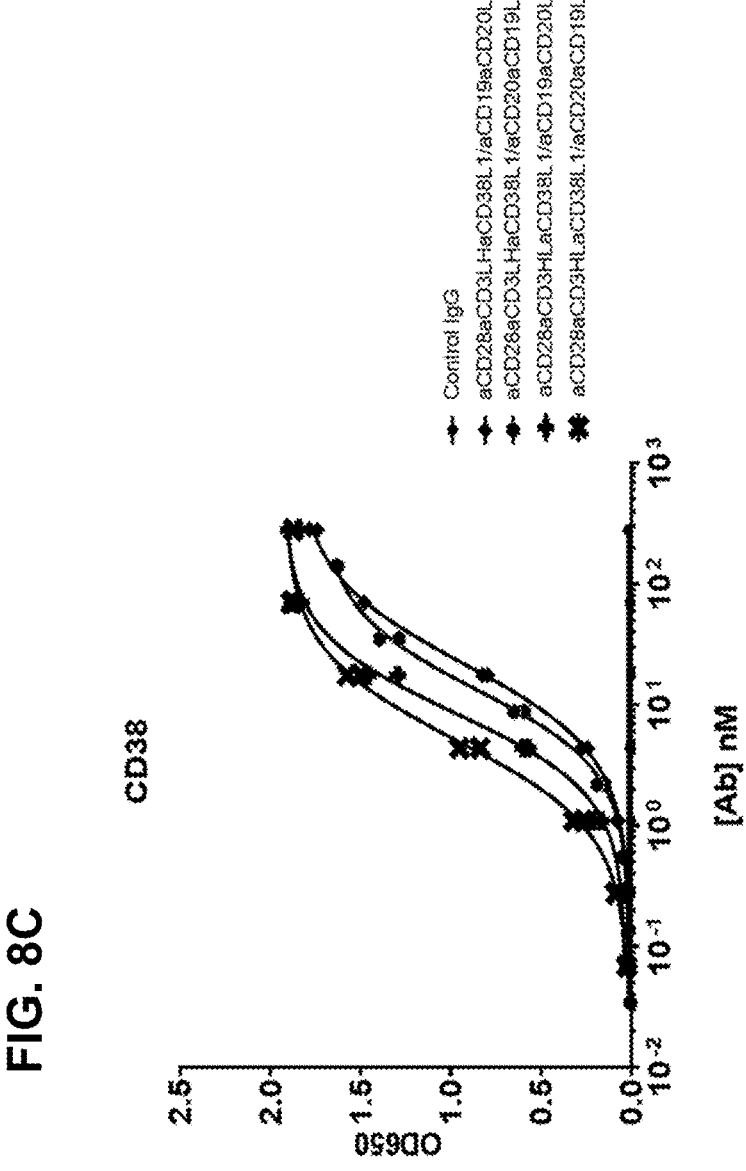
Figure 8D:
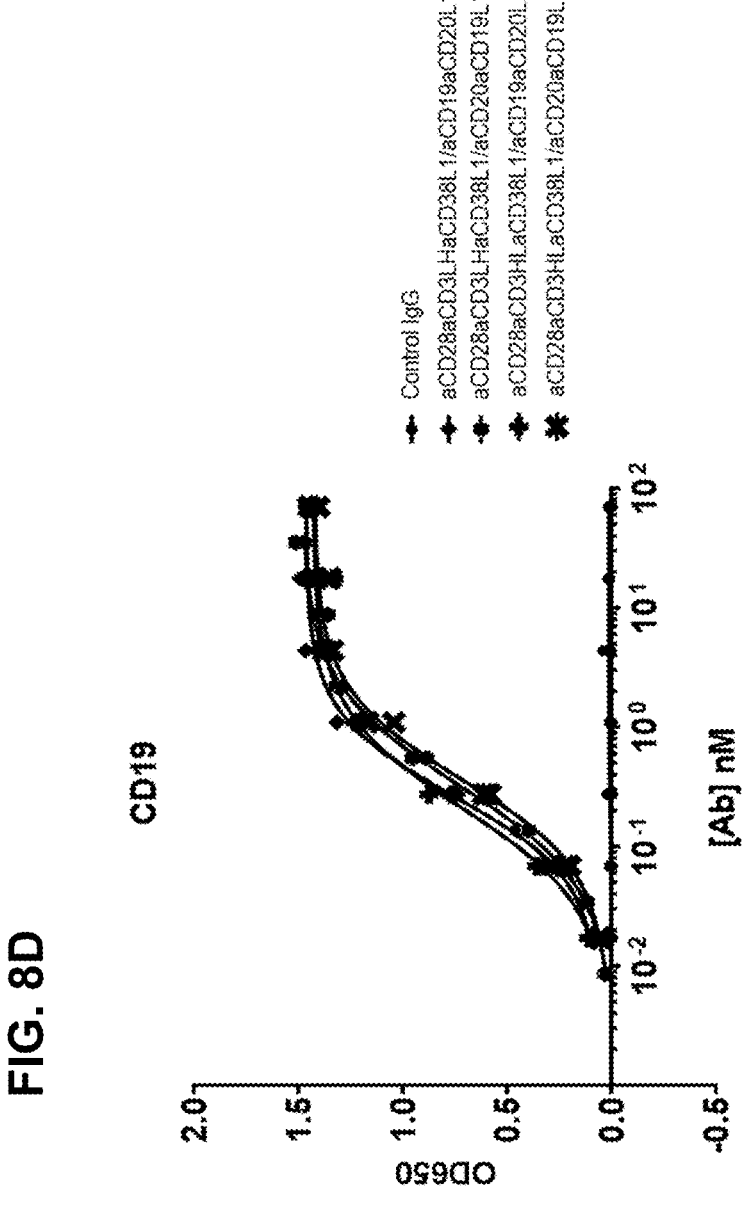

FIGS. 8A-8D show ELISA results of tetraspecific aCD28aCD3LHaCD38/aCD19aCD20, aCD28aCD3LHaCD38/aCD20aCD19, aCD28aCD3HLaCD38/aCD19aCD20, aCD28aCD3HLaCD38/aCD20aCD19, or isotype control (Control IgG) binding to CD3 (FIG. 8A), CD28 (FIG. 8B), CD38 (FIG. 8C), and CD19 (FIG. 8D).

Example 4

Luciferase Reporter Assay

A luciferase reporter assay was used to test binding of multispecific antibodies to their target antigens. More specifically, NFkB Luciferase Reporter Jurkat Stable Cell Line (Signosis, CA, USA) and Jurkat-Lucia™ NFAT Cells (InvivoGen, CA, USA) were prepared according to the manufacturer's protocol. Briefly, cells were thawed for 2 min in a 37° C. water bath and gently transferred to a 15 mL conical centrifuge tube containing 10 mL pre-warmed R10 media. Cells were pelleted at 300 g for 5 min at room temperature. After removing the supernatant, cells were resuspended in 20 mL pre-warmed culture media and transferred to a 75 cm² culture flask, followed by incubation in a mammalian tissue culture incubator until cells were growing and stable (~3-4 days). Cells were maintained in culture media+selective antibiotics and normally used 7 days after thawing.

For antibody stimulation, multispecific or control antibodies were serially diluted in PBS and coated onto 96-well flat-bottom culture plates by incubating 2-4 hours in a 37° C. tissue culture incubator. NFkB Luciferase Reporter Jurkat Stable Cells were resuspended to 2×10⁶ cells/mL, with 100 µl of cells added to each well containing the antibodies, and incubated in a mammalian incubator for 24 hours. Assay plates were then taken out and allowed to equilibrate to ambient temperature (10-15 min). Bio-Glo™ Reagent (Promega Cat #G7941) (ambient temperature) was added at 50

μl for each well of assay plates. After 5 minutes, luminescence activity was measured using Varioskan microplate reader (Thermo Fisher). Data were plotted using GraphPad Prism software.

In addition, Jurkat-Lucia™ NFAT Cells were resuspended to 7.5×10⁵ cells/mL, with 200 μl of cells added to each well containing the antibodies and incubated in a mammalian incubator for 24 hours. 20 uL of the cell culture supernatant was pipetted into a new 96-well white-walled microtiter plate. 50 uL of Quanti-Luc solution (InvivoGen) was then added to each well before luminescence activity was measured using Varioskan microplate reader (Thermo Fisher). Data were plotted using GraphPad Prism software.

Figure 4A:
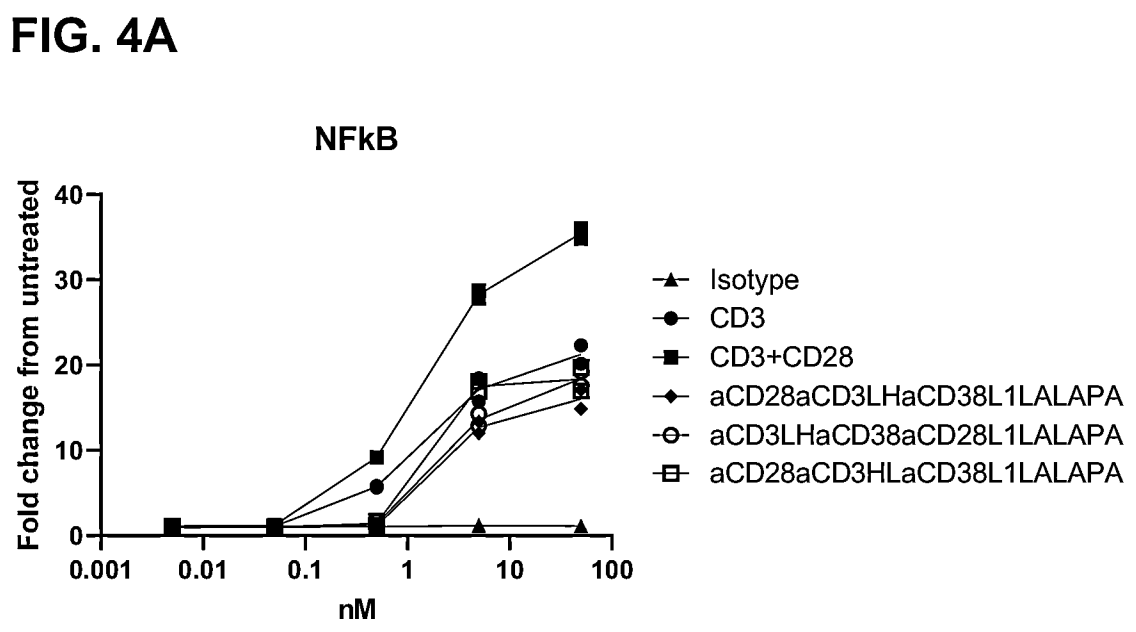
Figure 4B:
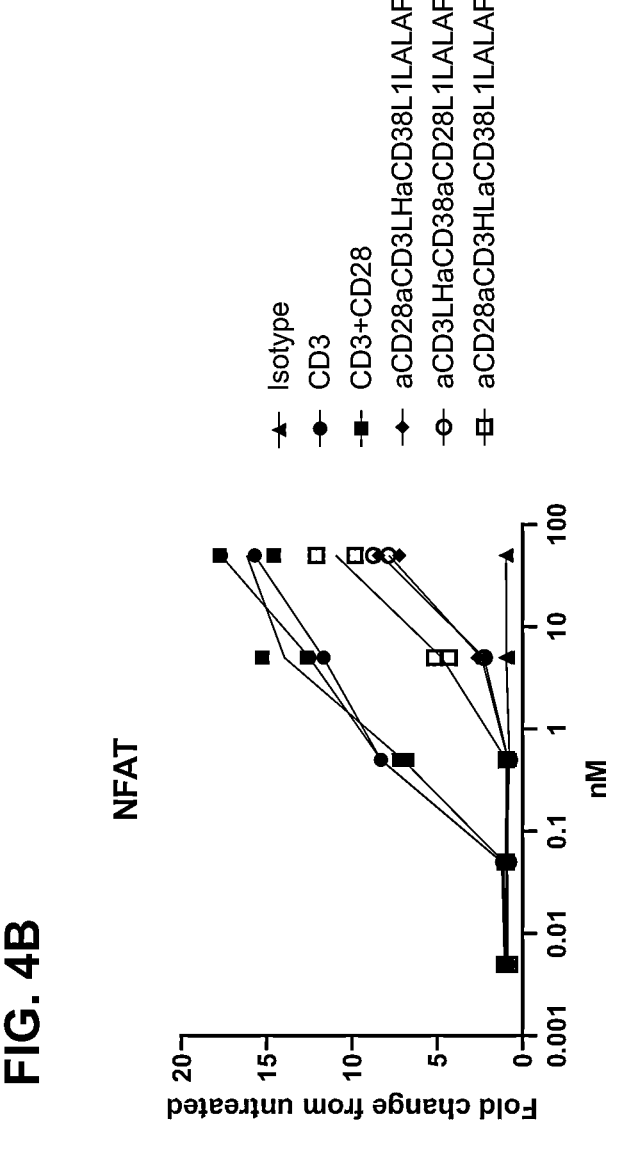
Figure 5:
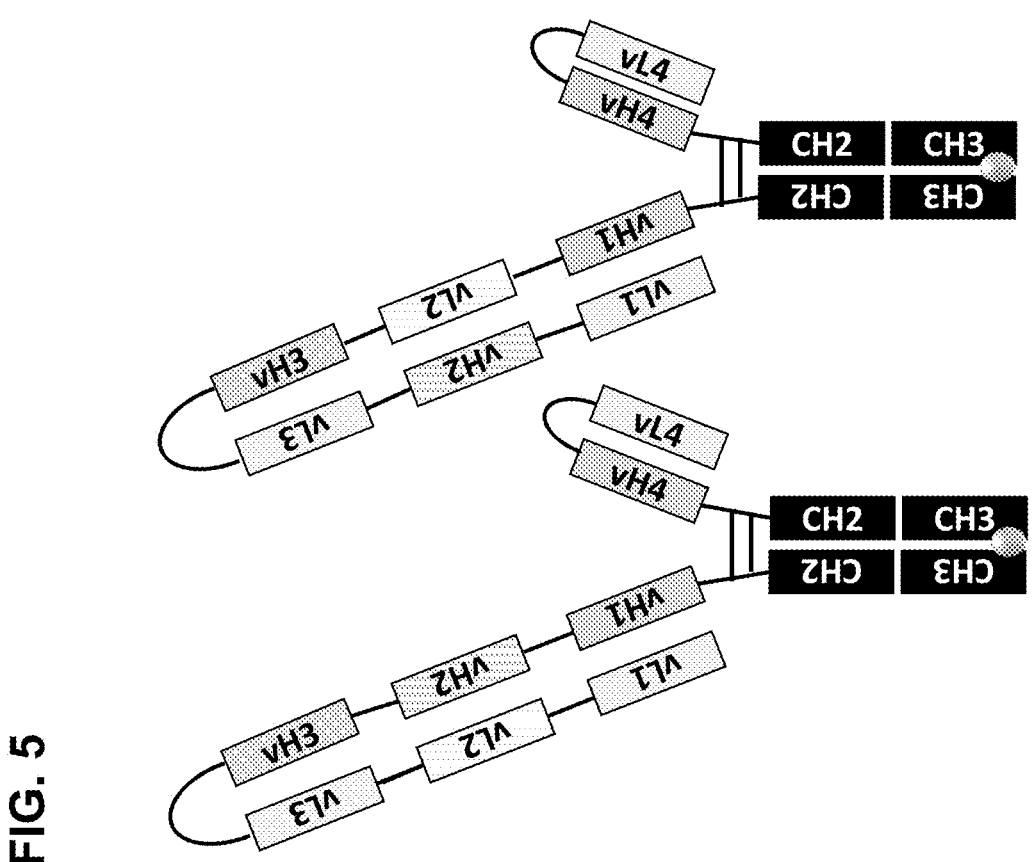
FIG. 5 shows non-limiting examples of different configurations of tetraspecific antibody molecules. As used in FIG. 5, vL1 is a first immunoglobulin light chain variable region. vL2 is a second immunoglobulin light chain variable region. vL3 is a third immunoglobulin light chain variable region. vL4 is a fourth immunoglobulin light chain variable region. vH1 is a first immunoglobulin heavy chain variable region. vH2 is a second immunoglobulin heavy chain variable region. vH3 is a third immunoglobulin heavy chain variable region. vH4 is a fourth immunoglobulin heavy chain variable region. CH2 is an immunoglobulin heavy chain constant region 2. CH3 is an immunoglobulin heavy chain constant region 3. The circle symbol in the CH3 region indicates a knob-into-hole modification.

FIGS. 4A-4B shows NFκB (FIG. 4A) and nuclear factor of activated T-cells (NFAT) (FIG. 4B) pathway activation by trispecific aCD28aCD3LHaCD38 LALAPAFc, aCD3LHaCD28aCD38 LALAPAFc, aCD3LHaCD38aCD28 LALAPAFc, aCD28aCD3HLaCD38 LALAPAFc, or isotype control (Control IgG) or anti-CD3 and anti-CD28 mAbs using NFκB or NFAT promoter-luciferase expressing human Jurkat T cells.

Example 5

Binding Analyses by BioLayer-Interferometry

Figure 9:
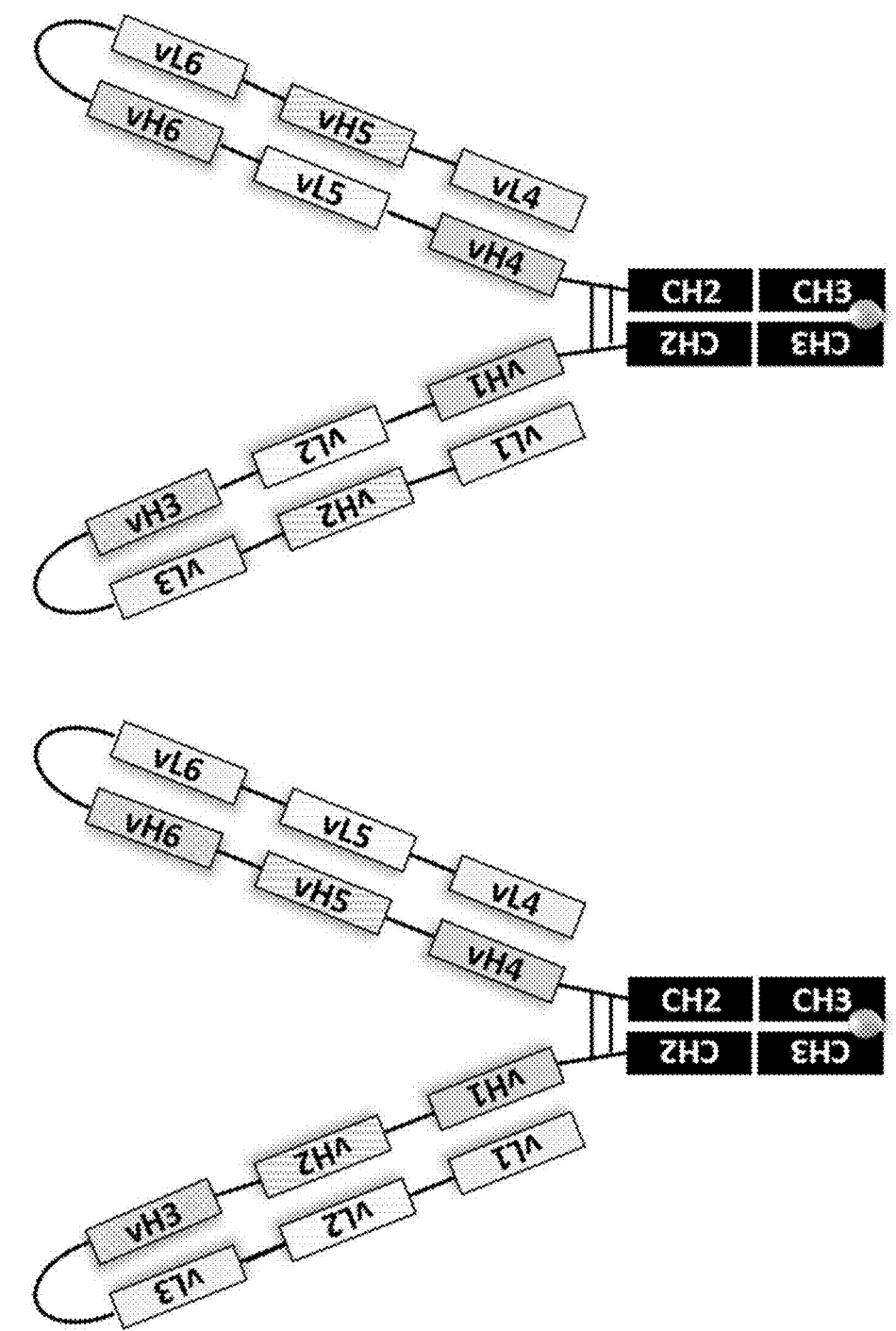
FIG. 9 shows non-limiting examples of different configurations of hexaspecific antibody molecules. As used in FIG. 9, vL1 is a first immunoglobulin light chain variable region. vL2 is a second immunoglobulin light chain variable region. vL3 is a third immunoglobulin light chain variable region. vL4 is a fourth immunoglobulin light chain variable region. vL5 is a fifth immunoglobulin light chain variable region. vL6 is a sixth immunoglobulin light chain variable region. vH1 is a first immunoglobulin heavy chain variable region. vH2 is a second immunoglobulin heavy chain variable region. vH3 is a third immunoglobulin heavy chain variable region. vH4 is a fourth immunoglobulin heavy chain variable region. vH5 is a fifth immunoglobulin heavy chain variable region. vH6 is a sixth immunoglobulin heavy chain variable region. CH2 is an immunoglobulin heavy chain constant region 2. CH3 is an immunoglobulin heavy chain constant region 3. The circle symbol in the CH3 region indicates a knob-into-hole modification.

The construct aCD3aCD28LHaCD38/ aCD33aCD123LHaBCMA (SEQ ID NOs:94-97; FIG. 9) was analyzed for binding using BioLayer-Interferometry (BLI). On the Octet® R8 (Sartorius), recombinant His-tagged CD3, CD28, CD38, BMCA, CD123, or CD33 was loaded by His-tag capture onto HIS1K biosensors (100 nM ligand, 300 seconds, 1000 RPM). After baseline step (100 seconds, 1000 RPM), association with hexaspecific antibody analyte was monitored (300 seconds, 1000 RPM). Dissociation was then monitored (300 seconds, 1000 RPM).

All assay steps occurred in 1× kinetic buffer (1×PBS pH7.4; 0.1% BSA; 0.02% Tween-20) at 24 degrees. Prior to each kinetic cycle, the HIS1K biosensors were regenerated in 1.5 pH glycine (5 seconds, 1000 RPM) and neutralized in 1× kinetic buffer (5 seconds, 1000 RPM) 5 consecutive times and then equilibrated back to 1× kinetic buffer (100 seconds; 1000 RPM).

Figure 10A:
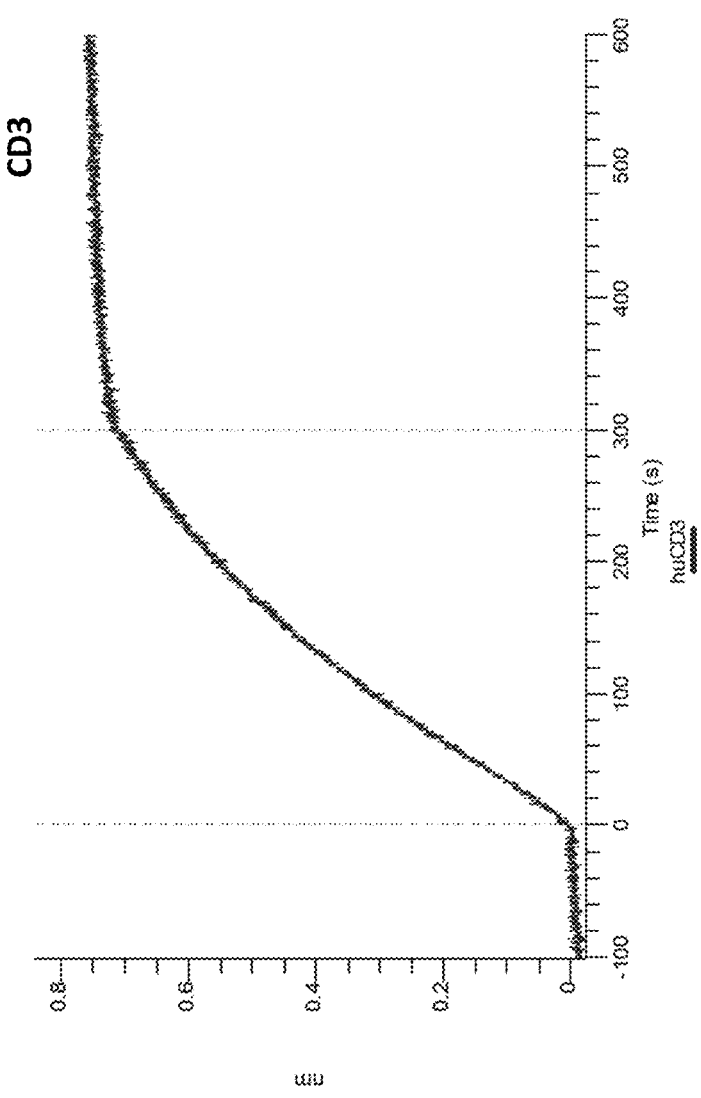
Figure 10B:
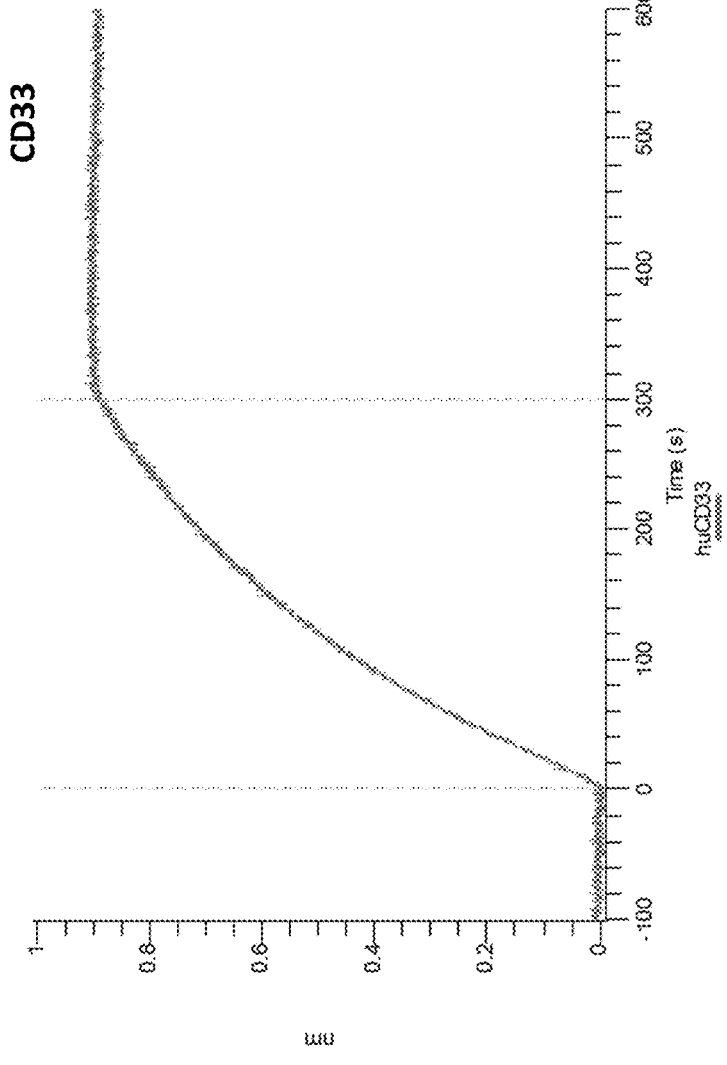
Figure 10C:
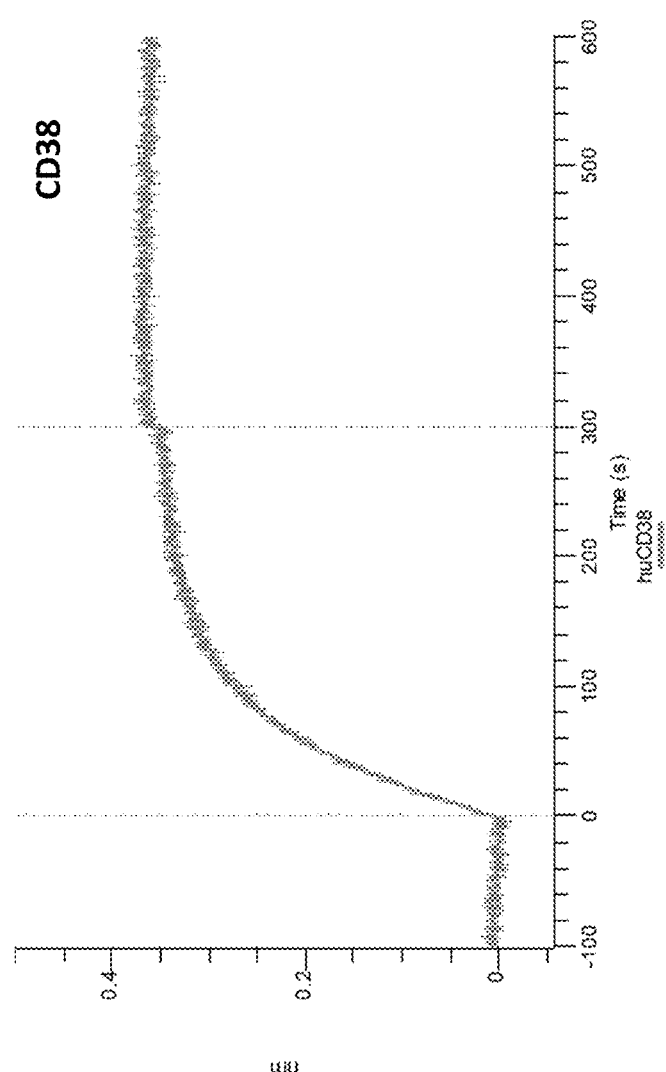
Figure 10D:
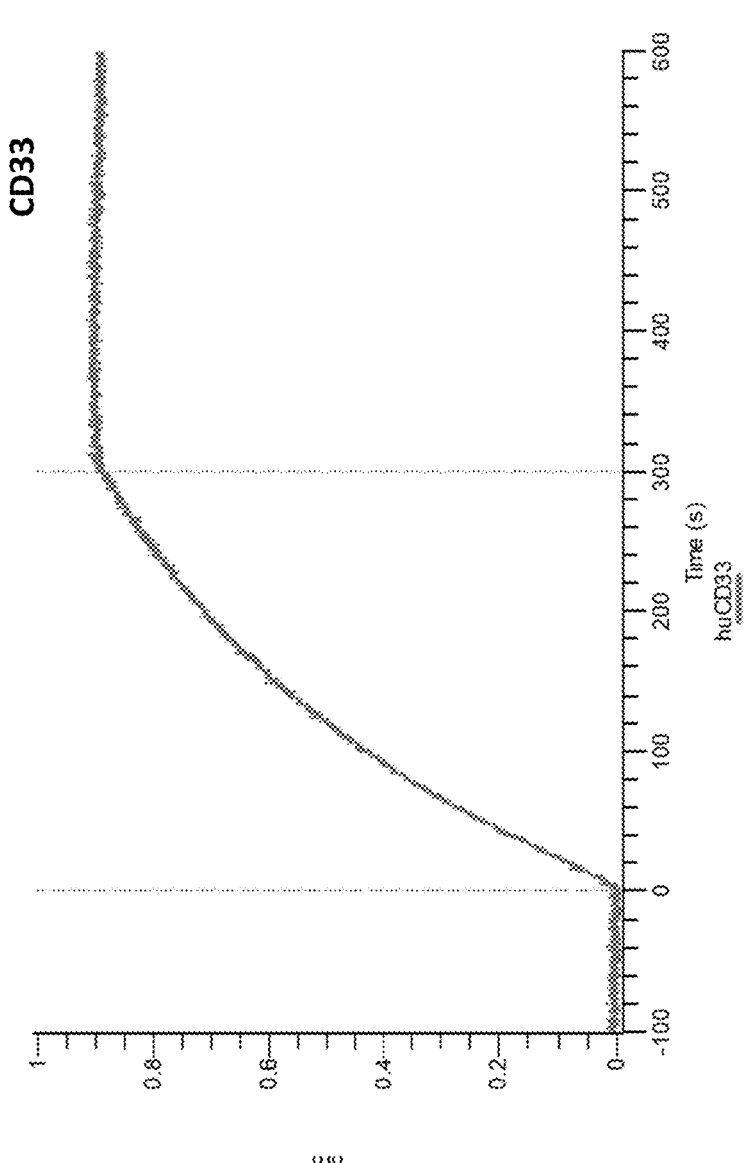
Figure 10E:
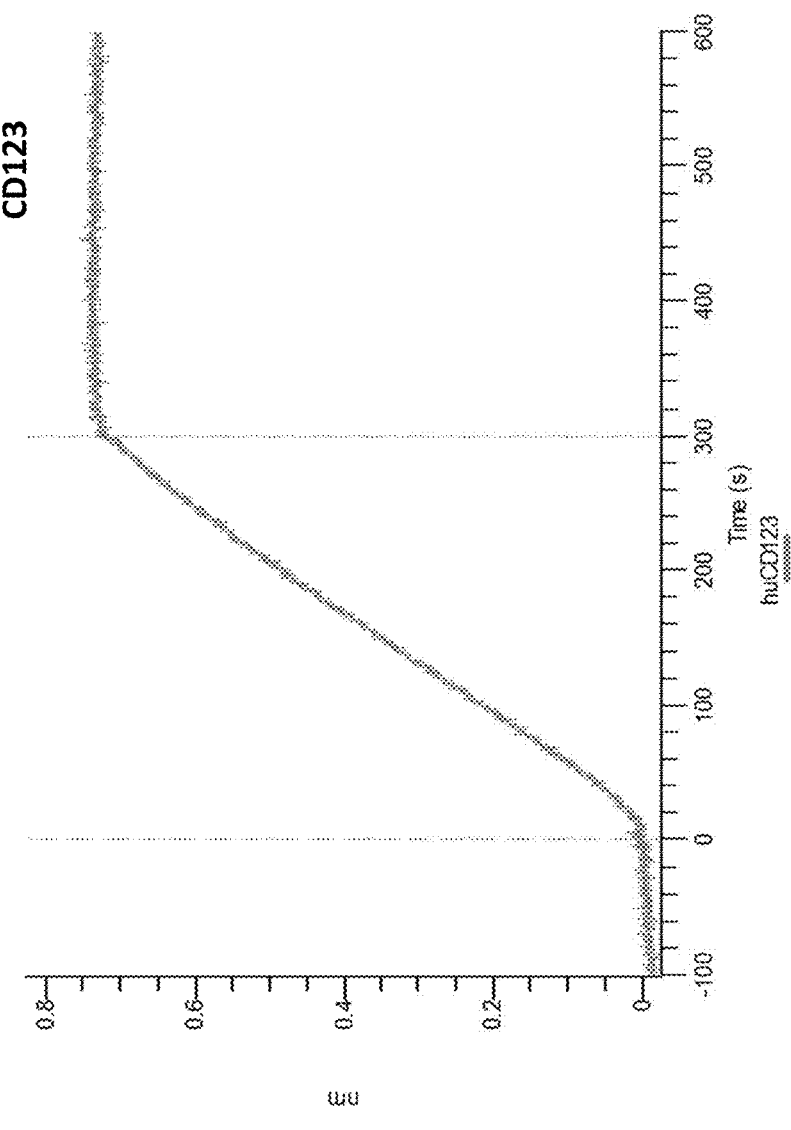
Figure 10F:
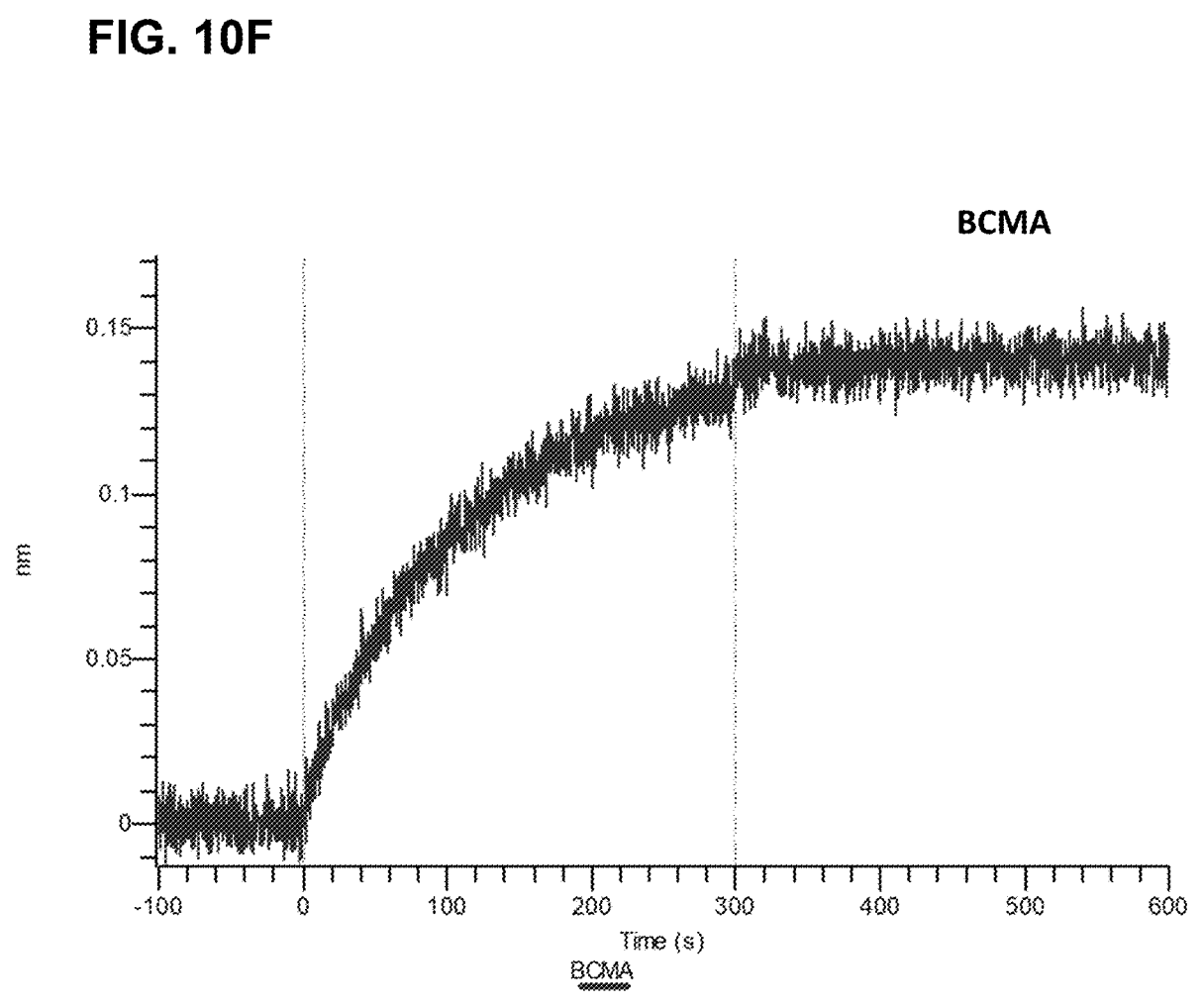

Results are shown in FIGS. 10A-10F and FIGS. 11A-11F. FIGS. 10A-10F show biolayer interferometry (BLI) binding of hexaspecific aCD3aCD28LHaCD38/ aCD33aCD123LHaBCMA antibody at 80 nM to CD3 (FIG. 10A), CD28 (FIG. 10B), CD38 (FIG. 10C), CD33 (FIG. 10D), CD123 (FIG. 10E), and BCMA (FIG. 10F).

Figure 11A:
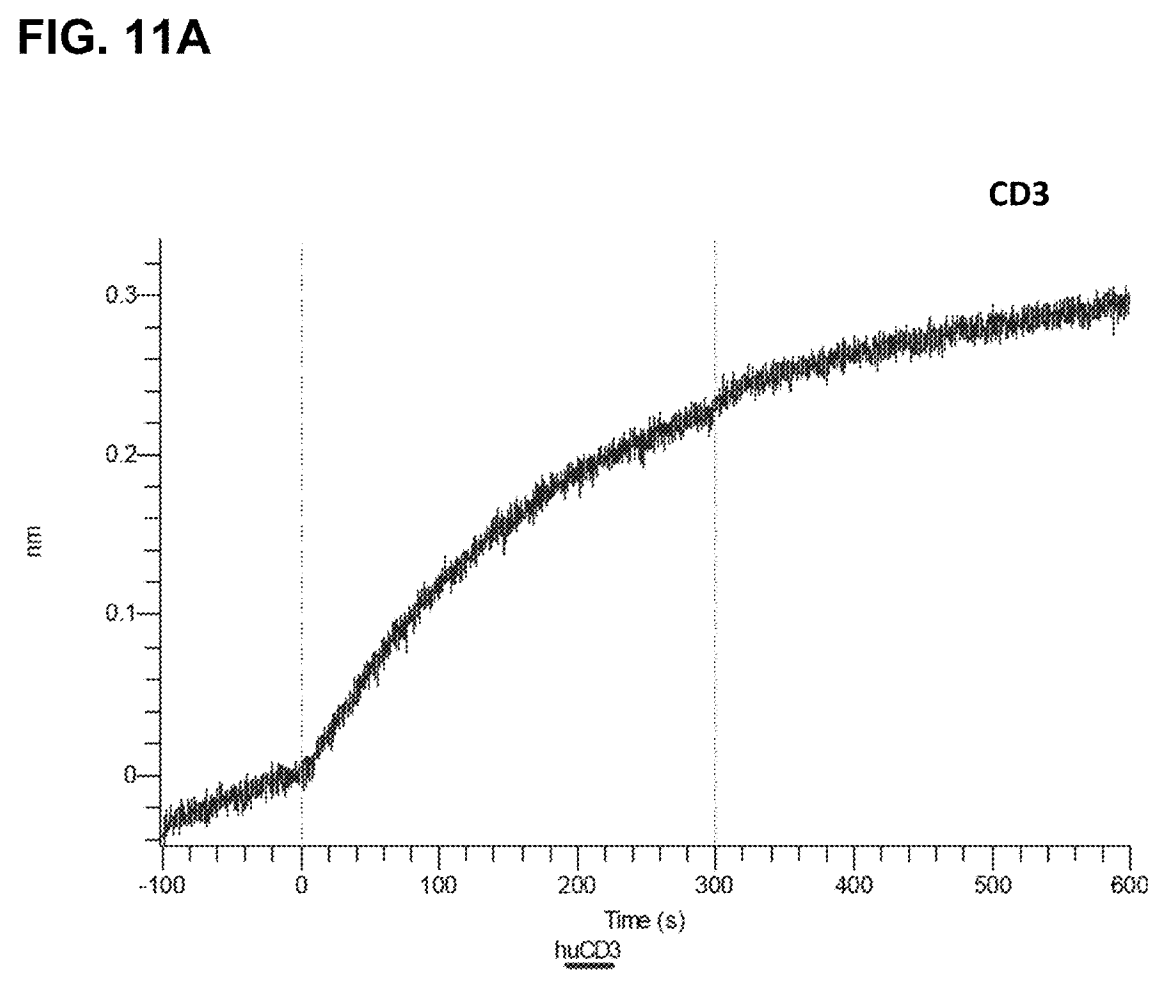
Figure 11B:
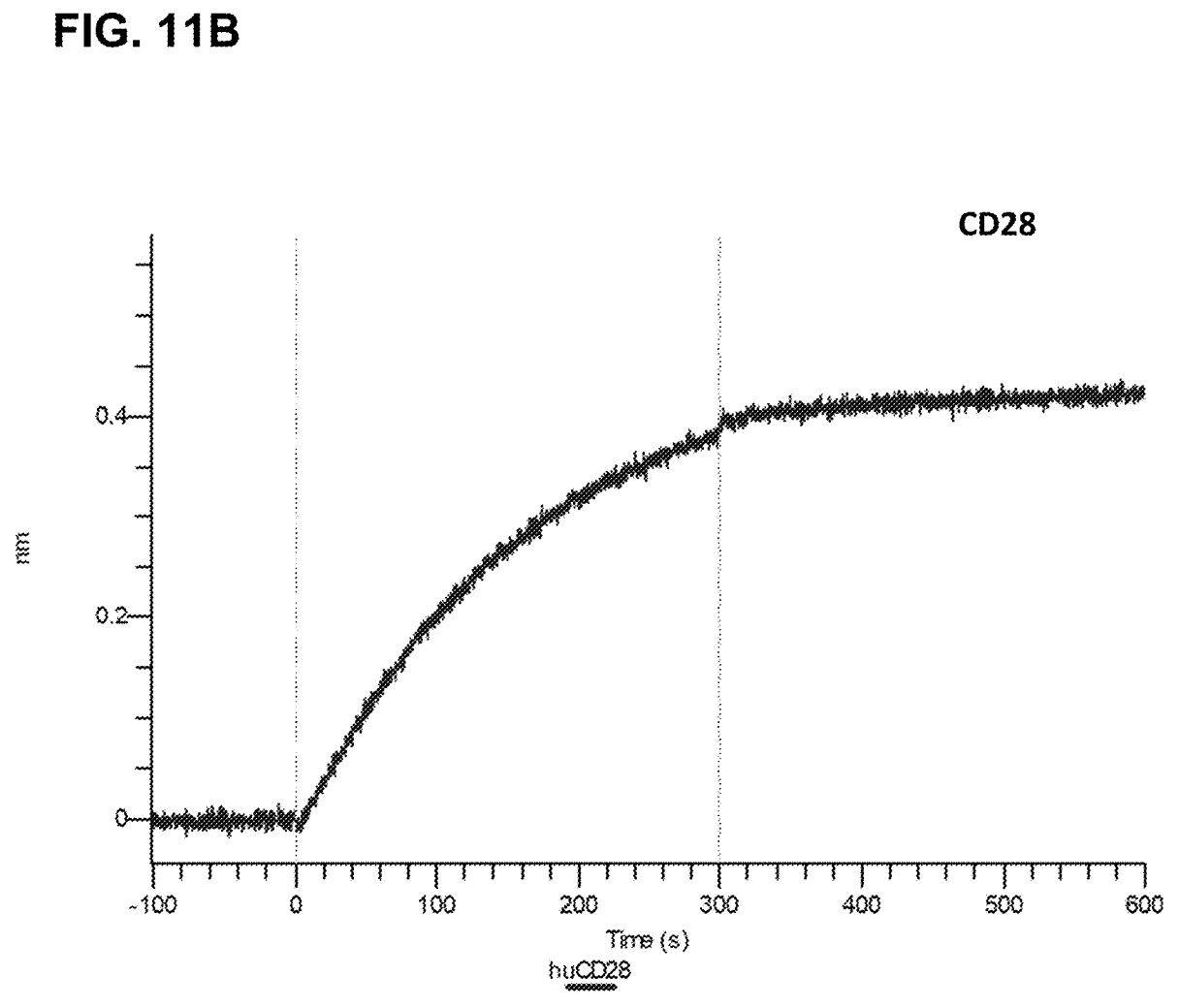
Figure 11C:
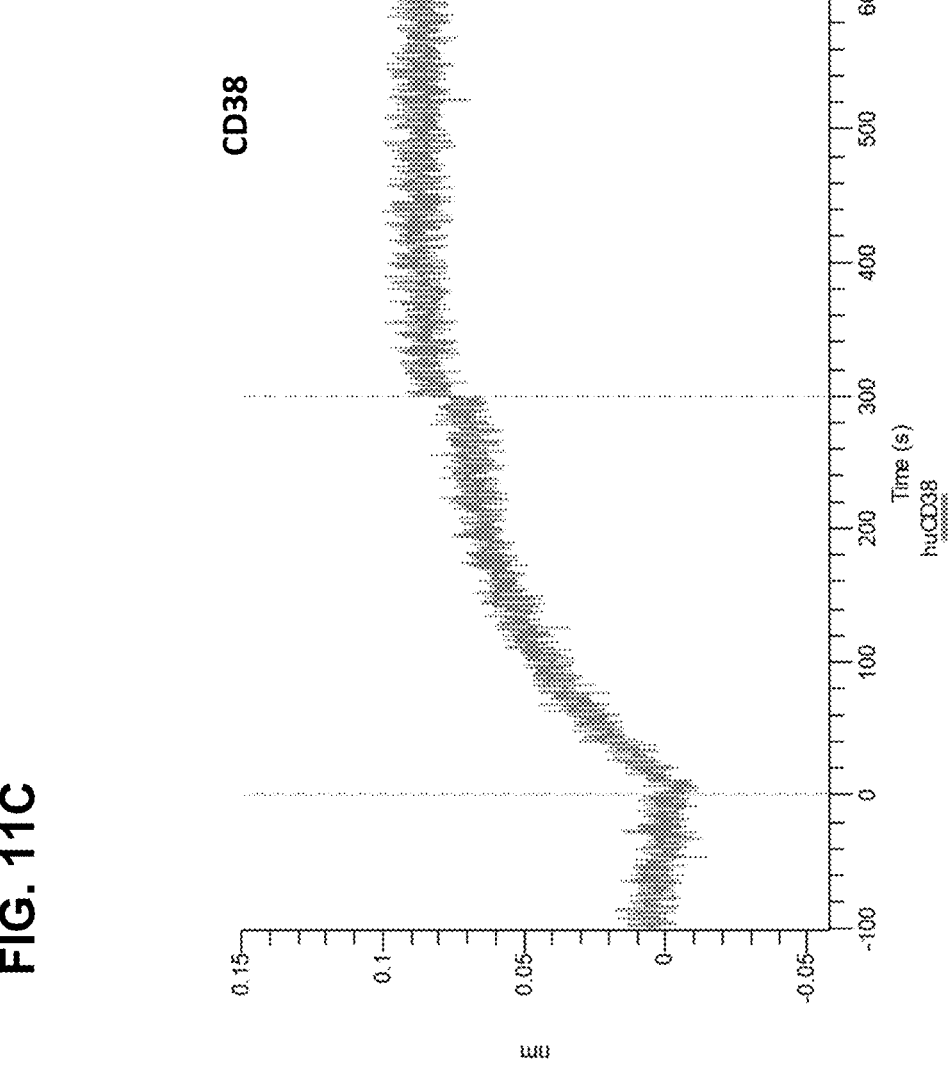
Figure 11D:
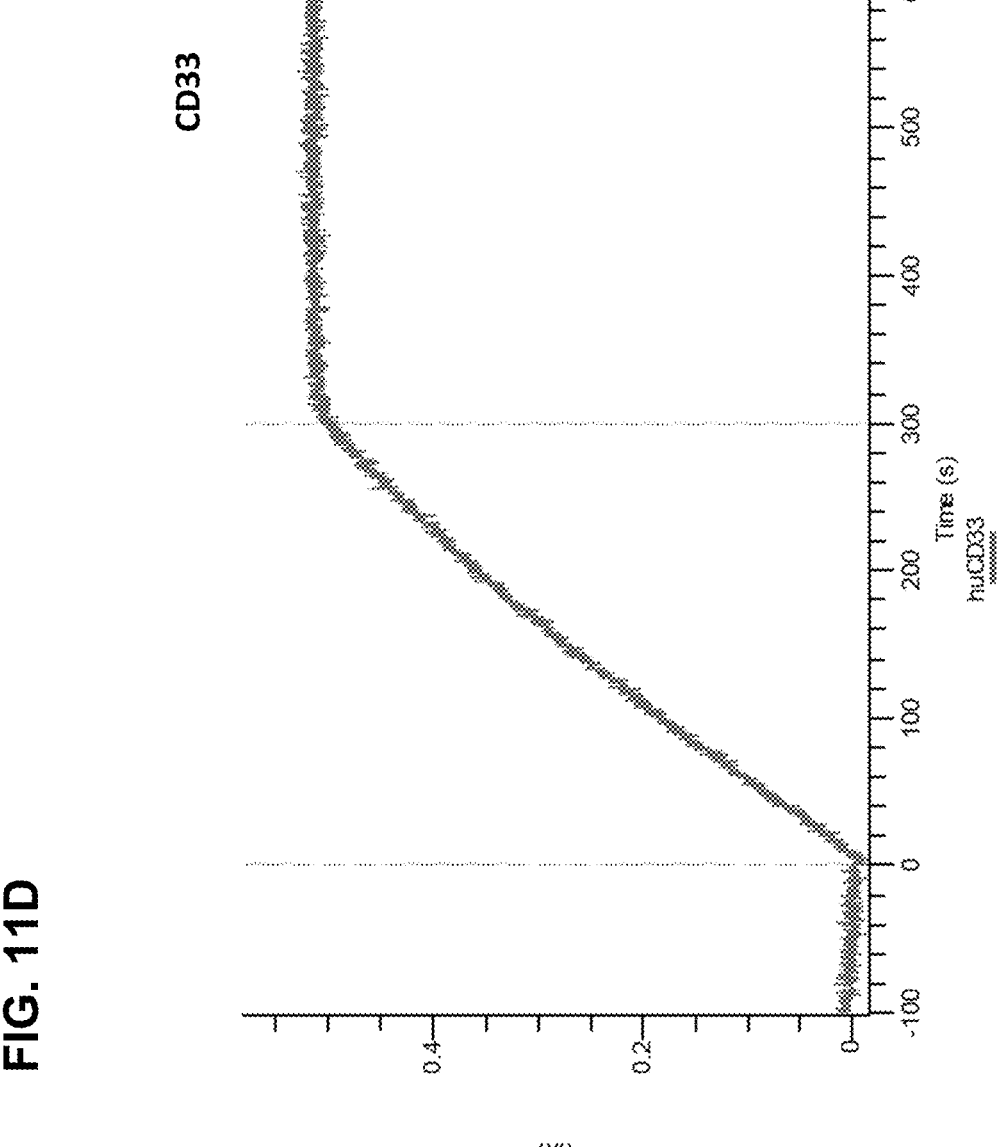
Figure 11E:
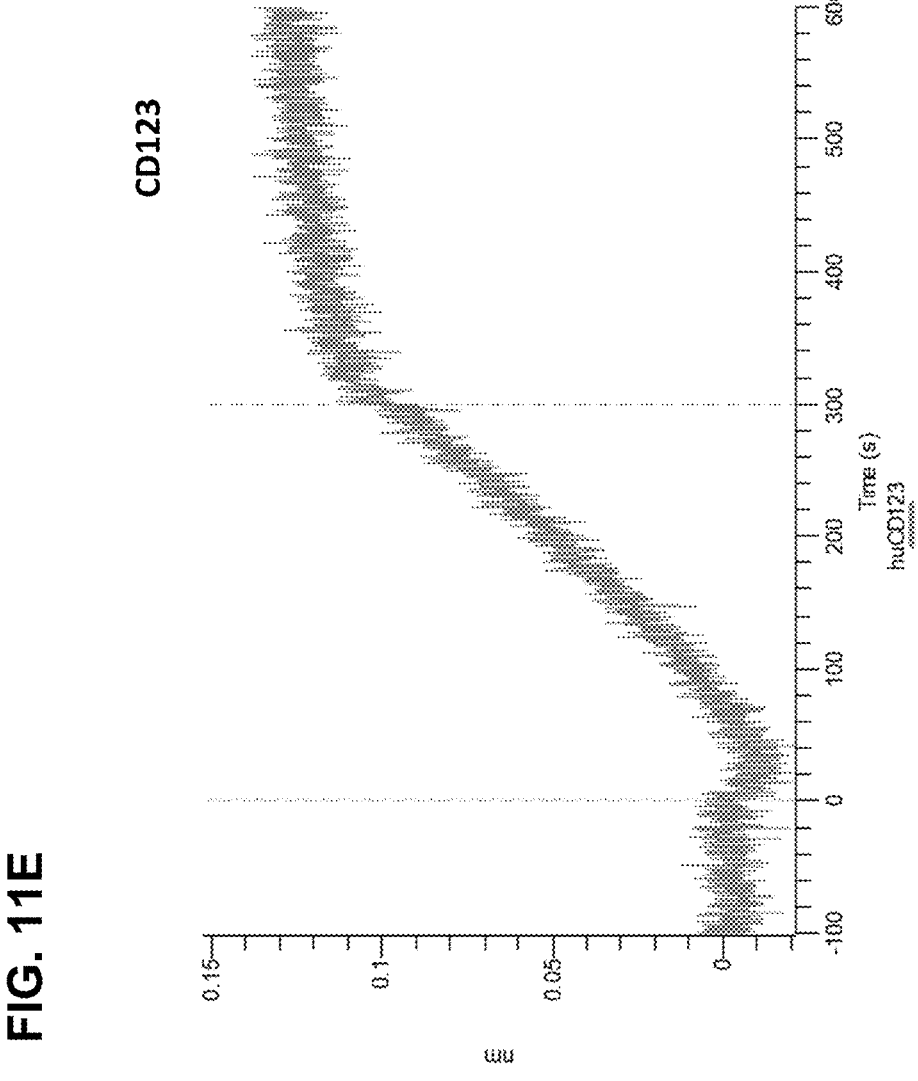
Figure 11F:
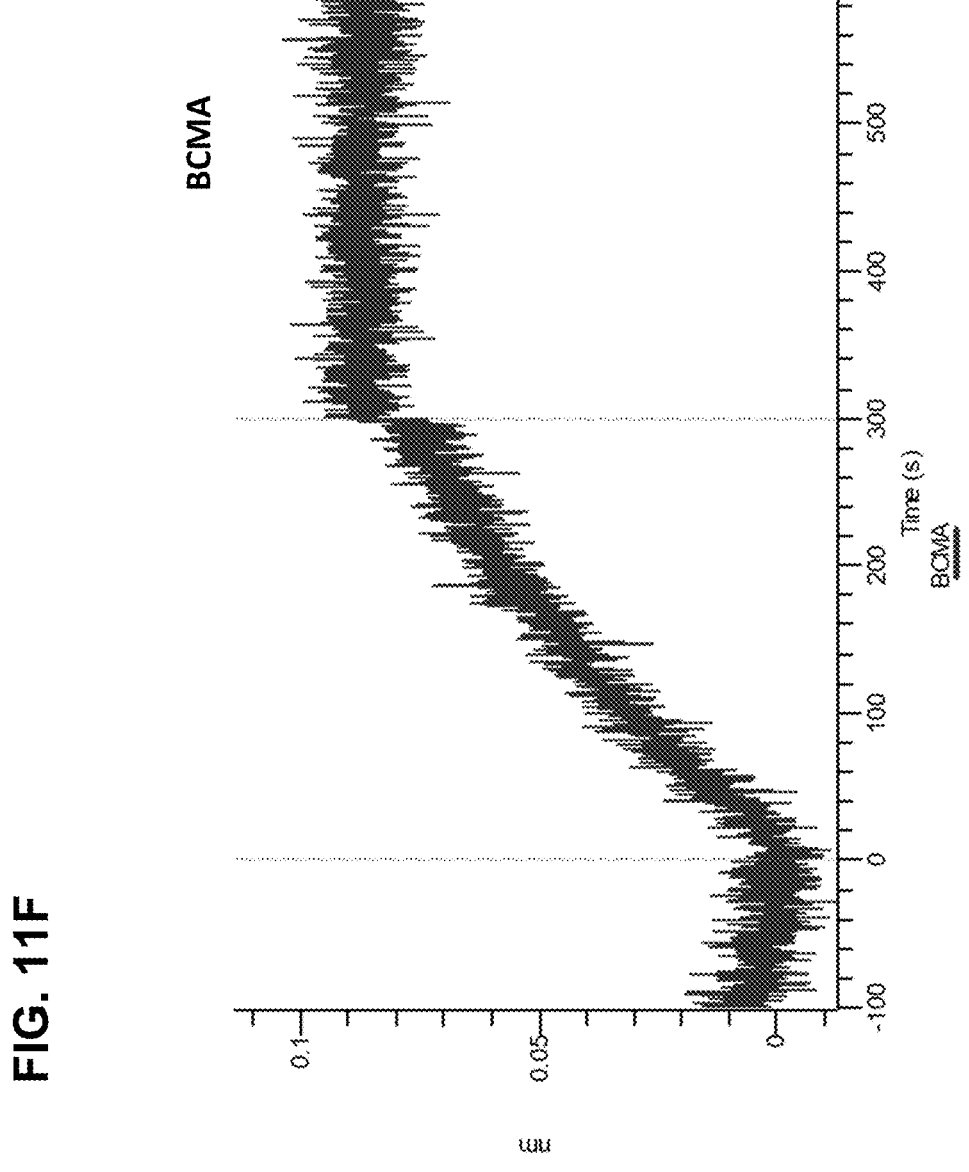

FIGS. 11A-11F show biolayer interferometry (BLI) binding of hexaspecific aCD3aCD28LHaCD38/ aCD123aBCMALHaCD33 antibody at 40 nM to CD3 (FIG. 11A), CD28 (FIG. 11B), CD38 (FIG. 11C), CD33 (FIG. 11D), CD123 (FIG. 11E), and BCMA (FIG. 11F). These results show that aCD3aCD28LHaCD38/ aCD33aCD123LHaBCMA binds with high affinity to the tested antigens.

Example 6

Design of Bispecific and Tetraspecific Antibody Constructs

Non-limiting examples of bispecific and tetraspecific antibody configurations are shown in FIGS. 12A-12F, FIGS. 19A-19C and FIGS. 27A-27D. Such examples include, but are not limited to, an antigen binding polypeptide complex comprising a first polypeptide and a second polypeptide, each comprising an amino acid sequence of any one of SEQ ID NOs:310-348.

Antibody heavy chain variable domain (VH) and light chain variable domain (VL) sequences targeting human CD3, CD28, CD38, CD19 and Her2 were selected from publicly available databases (e.g., GenBank) or patents to illustrate the feasibility of constructing exemplary bispecific and tetraspecific antibodies of the invention. Linkers of various length and sequence connecting VH and VL regions in different orders and orientations were tested, with and without different motifs of constant domains (e.g., CL, CH1, CH2, CH3). "Knob" and "hole" substitutions were integrated into respective halves of the antibody Fc region when Fc heterodimerization was needed. Effector function or half-life extension mutations can also be incorporated into Fc regions when needed. Once the amino acid sequences for each bispecific or tetraspecific antibody molecule were assembled, DNA encoding these sequences were codon optimized, synthesized (Cambridge Biologics, LLC, Brookline, MA), and cloned into a eukaryotic expression vector.

Example 7

Antibody Expression and Purification

Bispecific and tetraspecific antibodies were produced by transient transfection of 1 or 2 expression plasmids into Expi293F cells at a density of 2.5-3.0×10⁶/ml using polyethylenimine (PEI; Polyscience). Plasmid DNA and PEI were diluted in OPTi-MEM (LifeTech) separately and mixed later. The plasmid/PEI mixture, at a ratio of 1:3 (w:w), was added to the cell culture 10 minutes after mixing. Valproic acid and sodium propionate were added to final concentrations of 0.5 mM and 5 mM, respectively, 16-20 hours post transfection. Supernatant was harvested 5 days post transfection, and filtered through a 0.45 um filter. Bispecific and tetraspecific antibodies were then purified first by affinity chromatography using either nickel-charged affinity resin (Ni-NTA, if His-tagged) or Protein A (if contained Fc) in batch mode according to the manufacture's standard procedures. After antibodies were eluted by either 500 mM imidazole (if His-tagged) from Ni-NTA, or using IgG elusion buffer (Thermo Fischer Scientific) from protein A, they were dialyzed into 10 mM Histidine (pH6.0)+25 mM NaCl overnight. Antibodies were further purified by size exclusion chromatography using Hiload 16/600 Superdex 200 PG or Superdex 200 Increase 10/300 GL (Cytiva Lifesciences). Fractions with the correct elusion profile were collected and concentrated for further characterization by SDS-PAGE.

Figures 12A, 12B, 12C:
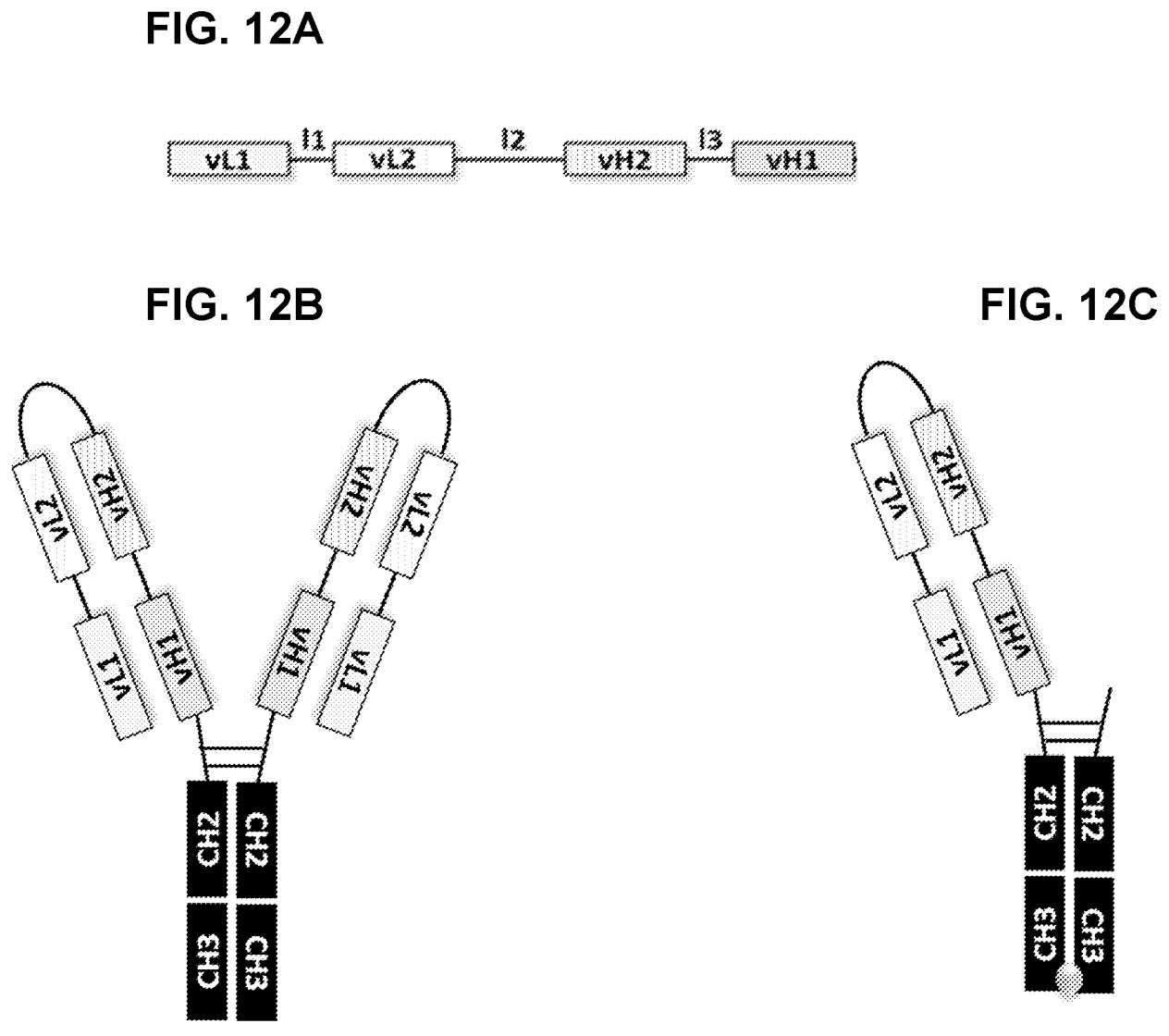
Figure 12:
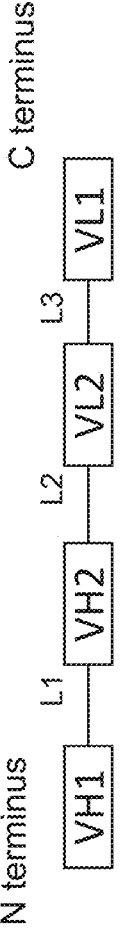
FIGS. 12A-12F show configurations of exemplary bispecific molecules from the N-terminus to the C-terminus of the single chain antigen binding polypeptide(s).
Figure 12:
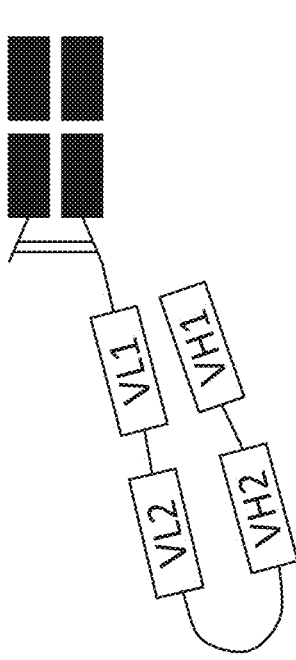
Figure 12F:
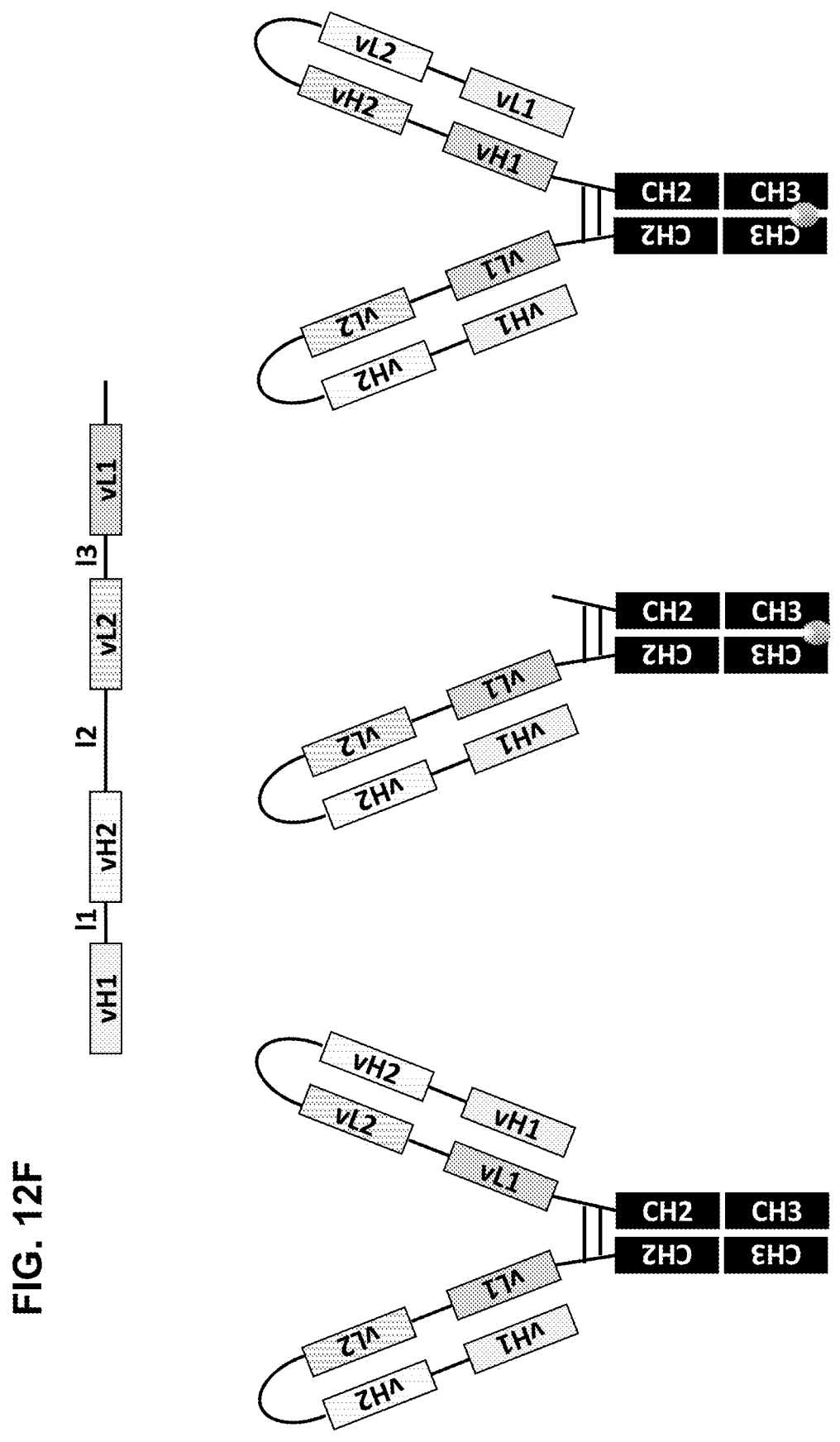

FIG. 13 shows SDS-PAGE results of Ni-NTA purified bispecific molecules with histidine tags, as depicted in FIG. 12A.

Figure 15:
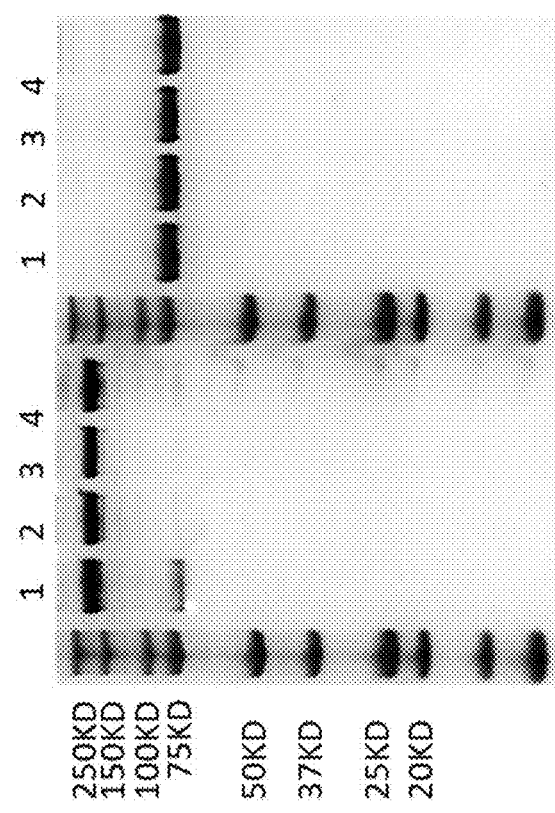
FIG. 15 shows SDS-PAGE results of protein A-purified bispecific, tetravalent molecules with LALAPA Fc, as depicted in FIG. 12B.

FIG. 15 shows SDS-PAGE results of protein A purified bispecific, tetravalent molecules with LALAPA Fc, as depicted in FIG. 12B.

Example 8

ELISA Binding Assay

An ELISA binding assay was used to test binding of bispecific and tetraspecific antibodies to their target antigens. Target protein for each binding site of bispecific and tetraspecific antibodies was coated in the wells of 96-well Immuno Plates (Thermo Fisher Scientific) overnight at 4° C. Coated plates were blocked using 5% skim milk+2% bovine serum albumin (BSA) in phosphate buffered saline (PBS)+ 0.25% Tween for one hour at room temperature, then washed three times with PBS+0.25% Tween 20. Serial diluted antibodies and control molecules were added to the plate and incubated at room temperature for 1 hr. Plates were washed three times with PBS+0.25% Tween 20, incubated with horseradish peroxidase (HPR) conjugated detection antibody for one hour at room temperature, washed again, and then developed with Peroxidase Substrate (KPL, Gaithersburg, MD, USA). After the reaction was terminated by adding 100 µl of KPL TMB BlueSTOP solution, plates were read at $OD_{650}$ using a plate reader and data analyzed in GraphPad Prism.

Figures 14A, 14B:
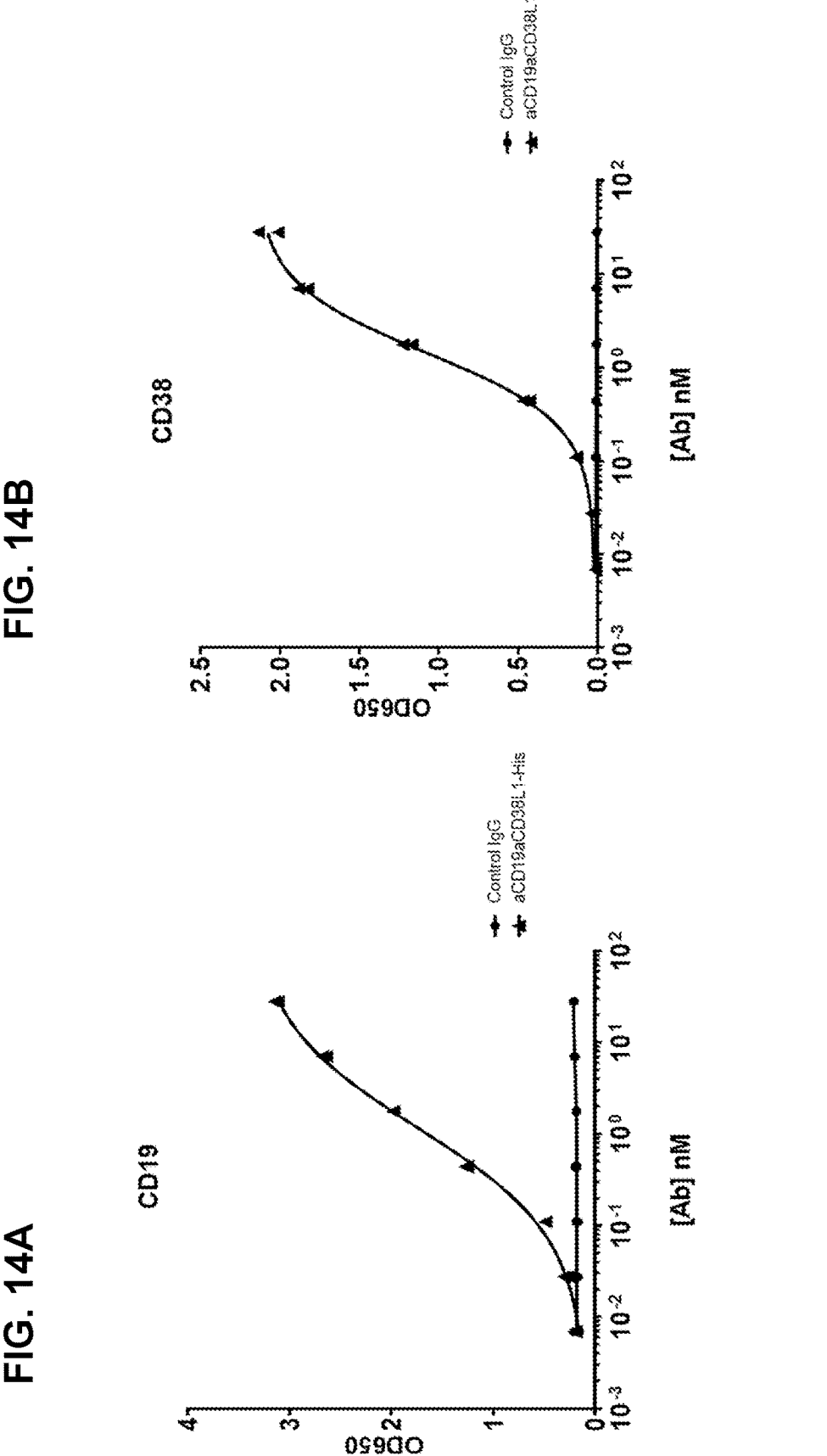
FIGS. 14A-14B show ELISA results of bispecific molecule aCD19aCD38-His or isotype control (Control IgG) binding to CD19 (FIG. 14A) and CD38 (FIG. 14B).

FIGS. 14A-14B show ELISA results of bispecific molecule aCD19aCD38-His or isotype control (Control IgG) binding to CD19 (FIG. 14A) and CD38 (FIG. 14B).

Figure 16A:
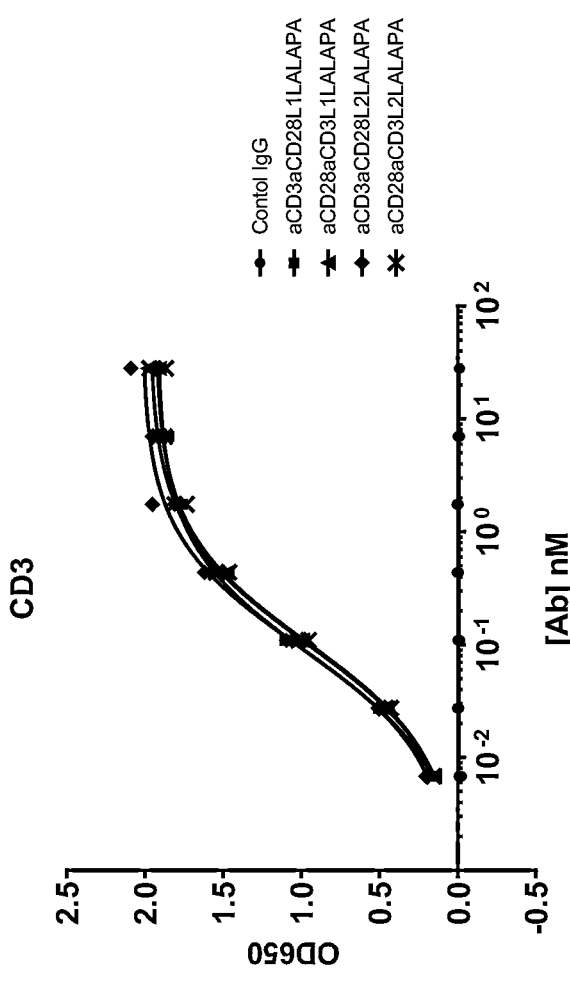
FIGS. 16A-16B show ELISA results of bispecific, tetravalent aCD28aCD3LALAPAFc, aCD3aCD28LALAPAFc, or isotype control (Control IgG) binding to CD3 (FIG. 16A) and CD28 (FIG. 16B). Molecule structures are depicted in FIG. 12C.
Figure 16B:
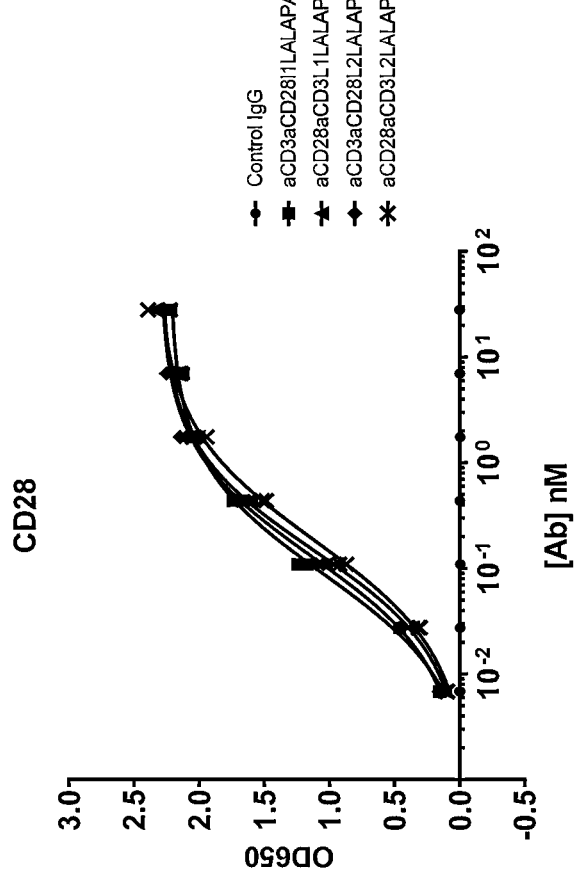

FIGS. 16A-16B show ELISA results of bispecific, tetravalent aCD28aCD3LALAPAFc, aCD3aCD28LALAPAFc, or isotype control (Control IgG) binding to CD3 (FIG. 16A) and CD28 (FIG. 16B).

Figures 18A, 18B:
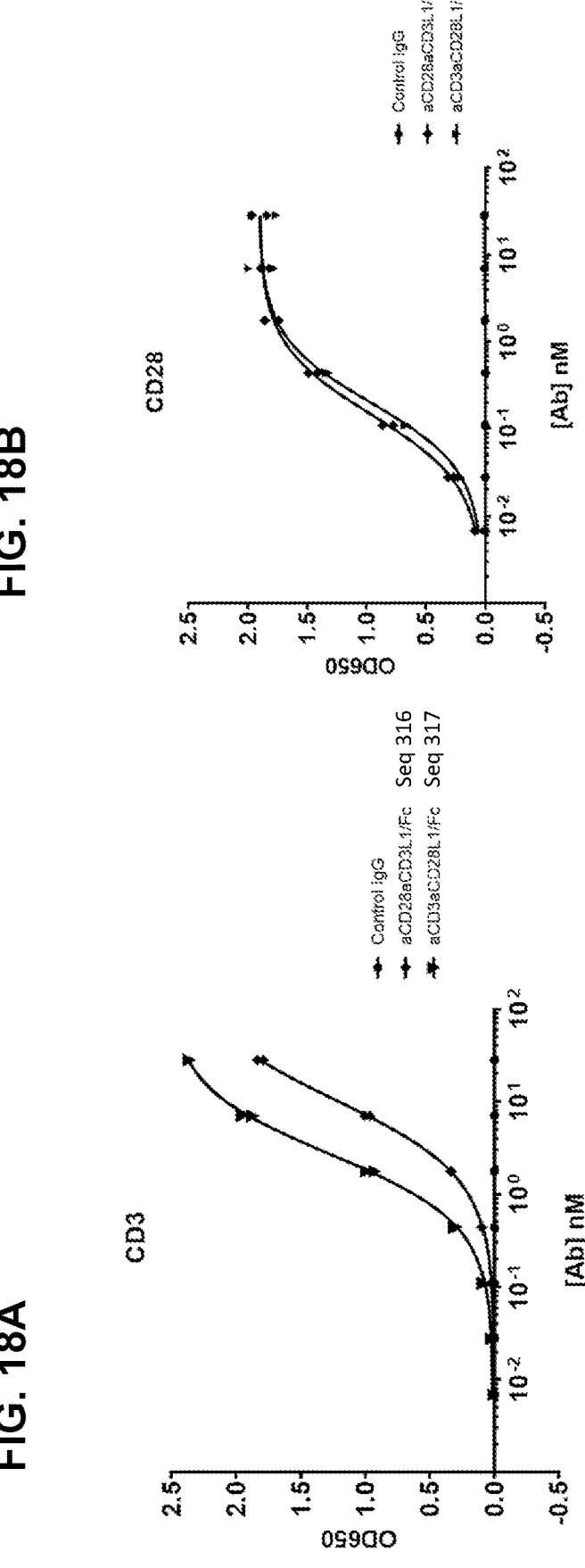
FIGS. 18A-18B show ELISA results of bispecific aCD28aCD3LALAPAFc or aCD3aCD28LALAPAFc, or isotype control (Control IgG) binding to CD3 (FIG. 18A) and CD28 (FIG. 18B). Molecule structures are depicted in FIG. 12C.

FIGS. 18A-18B show ELISA results of bispecific aCD28aCD3LALAPAFc or aCD3aCD28LALAPAFc, or isotype control (Control IgG) binding to CD3 (FIG. 18A) and CD28 (FIG. 18B).

Figure 20:
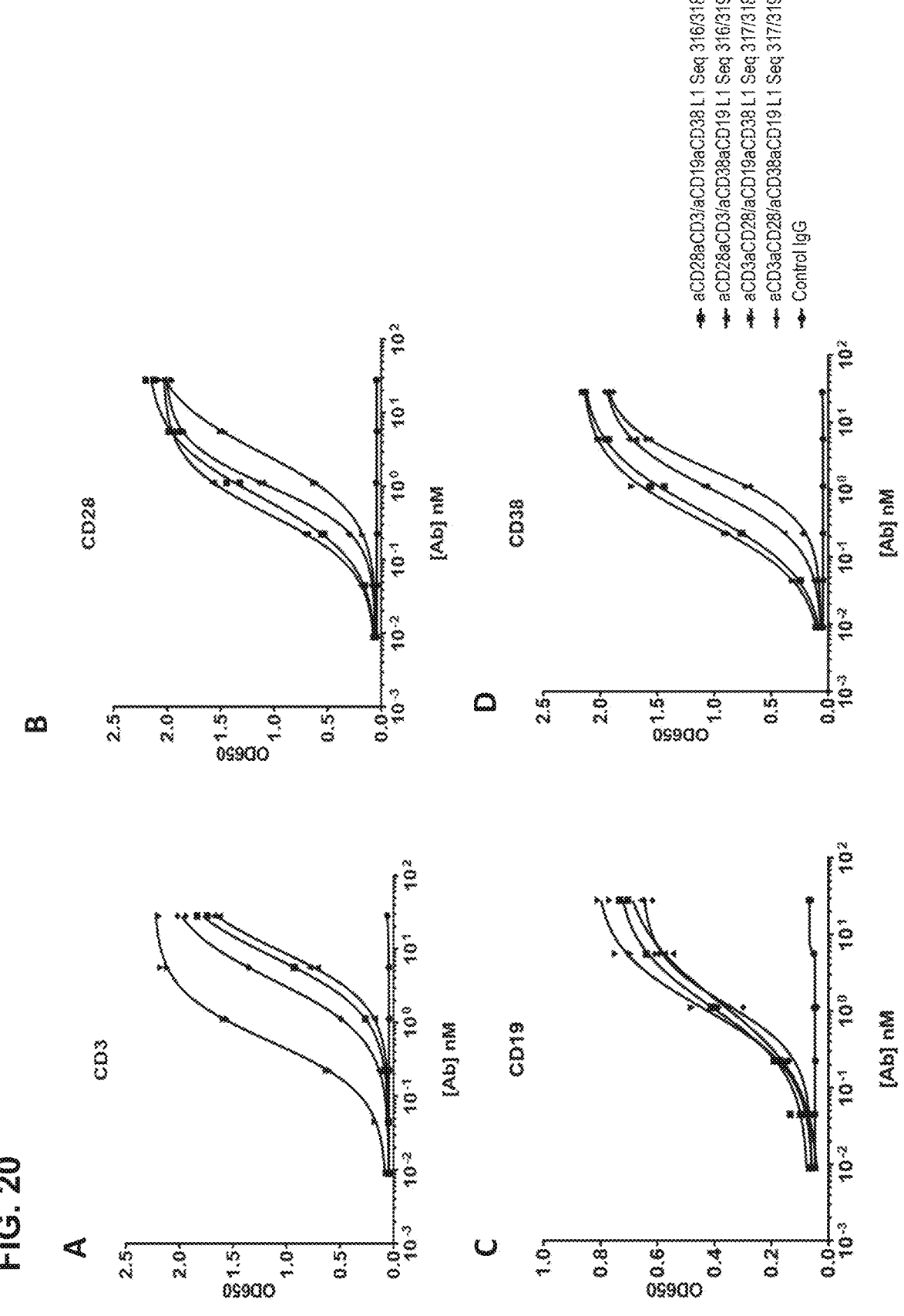
FIGS. 20A-20D show ELISA results of tetraspecific aCD28aCD3CD19CD38LALAPAFc, aCD3aCD28CD19CD38LALAPAFc, aCD28aCD3CD19CD38LALAPAFc, or aCD28aCD3CD38CD19LALAPAFc, or isotype control (Control IgG) binding to CD3 (FIG. 20A), CD28 (FIG. 20B), CD19 (FIG. 20C), and CD38 (FIG. 20D). Molecule structures are depicted in FIG. 19A.

FIGS. 20A-20D show ELISA results of tetraspecific aCD28aCD3CD19CD38LALAPAFc, aCD3aCD28CD19CD38LALAPAFc, aCD28aCD3CD19CD38LALAPAFc, or aCD28aCD3CD38CD19LALAPAFc, or isotype control (Control IgG) binding to CD3 (FIG. 20A), CD28 (FIG. 20B), CD19 (FIG. 20C), and CD38 (FIG. 20D).

FIG. 23 shows both orientation and linker can affect expression of tetraspecific molecules.

Figure 24:
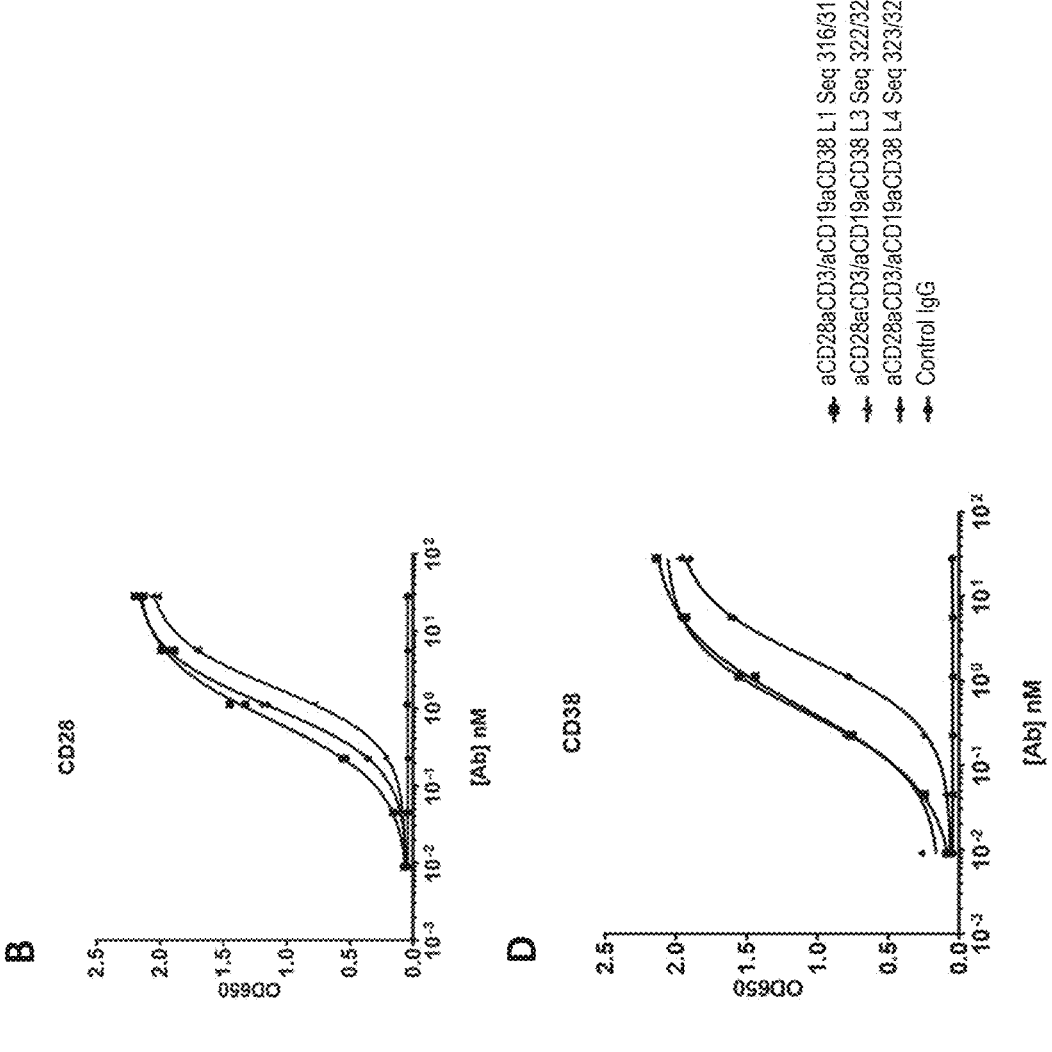
FIGS. 24A-24D show ELISA results of tetraspecific aCD28aCD3CD19CD38LALAPAFc with different linker lengths as depicted in FIG. 23, or isotype control (Control IgG) binding to CD3 (FIG. 24A), CD28 (FIG. 24B), CD19 (FIG. 24C), and CD38 (FIG. 24D).
Figure 24:
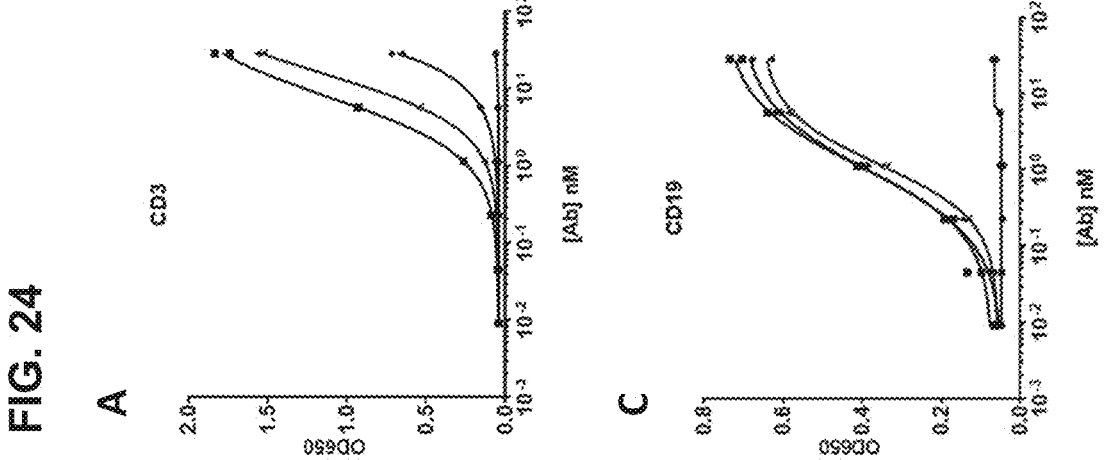

FIGS. 24A-24D show ELISA results of tetraspecific aCD28aCD3CD19CD38LALAPAFc with different linker lengths as depicted in FIG. 23, or isotype control (Control IgG) binding to CD3 (FIG. 24A), CD28 (FIG. 24B), CD19 (FIG. 24C), and CD38 (FIG. 24D).

Figure 19:
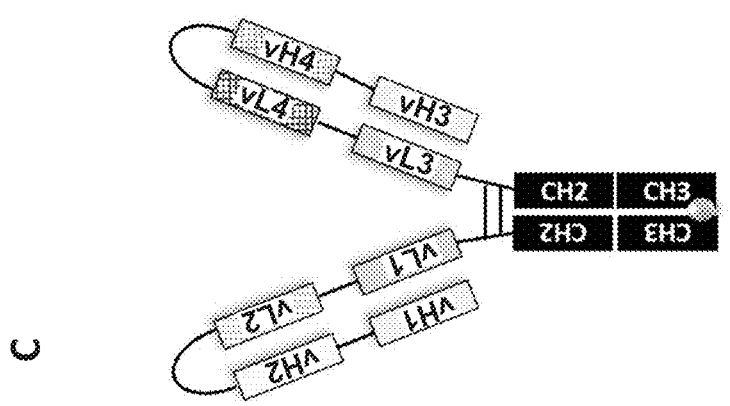
FIGS. 19A-19C show configurations of exemplary tetraspecific molecules. VL1 refers to a first immunoglobulin light chain variable region. VL2 refers to a second immunoglobulin light chain variable region. VL3 refers to a third immunoglobulin light chain variable region. VL4 refers to a fourth immunoglobulin light chain variable region. VH1 refers to a first immunoglobulin heavy chain variable region. VH2 refers to a second immunoglobulin heavy chain variable region. VH3 refers to a third immunoglobulin heavy chain variable region. VH4 refers to a fourth immunoglobulin heavy chain variable region. CH1 refers to an immunoglobulin heavy chain constant region 1. CH2 refers to an immunoglobulin heavy chain constant region 2. CH3 refers to an immunoglobulin heavy chain constant region 3. CL refers to an immunoglobulin light chain constant region. The circle symbol in FIGS. 19A-19C refers to a knob-into-hole modification.
Figure 19:
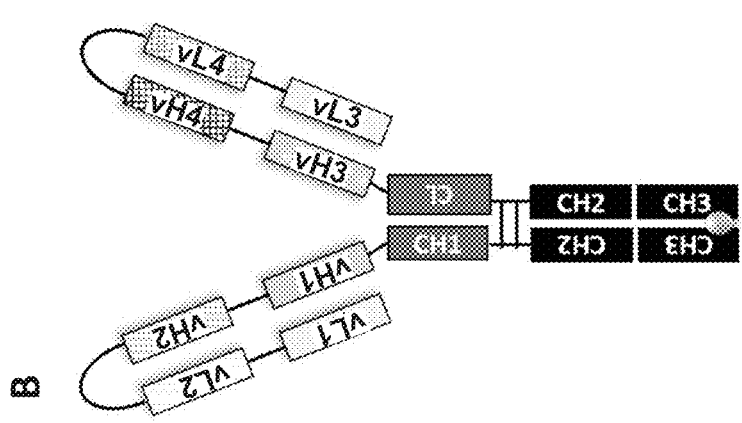
Figure 19:
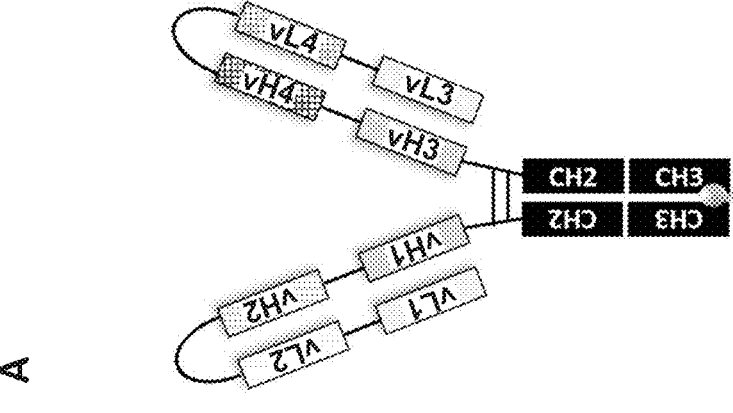
Figure 25:
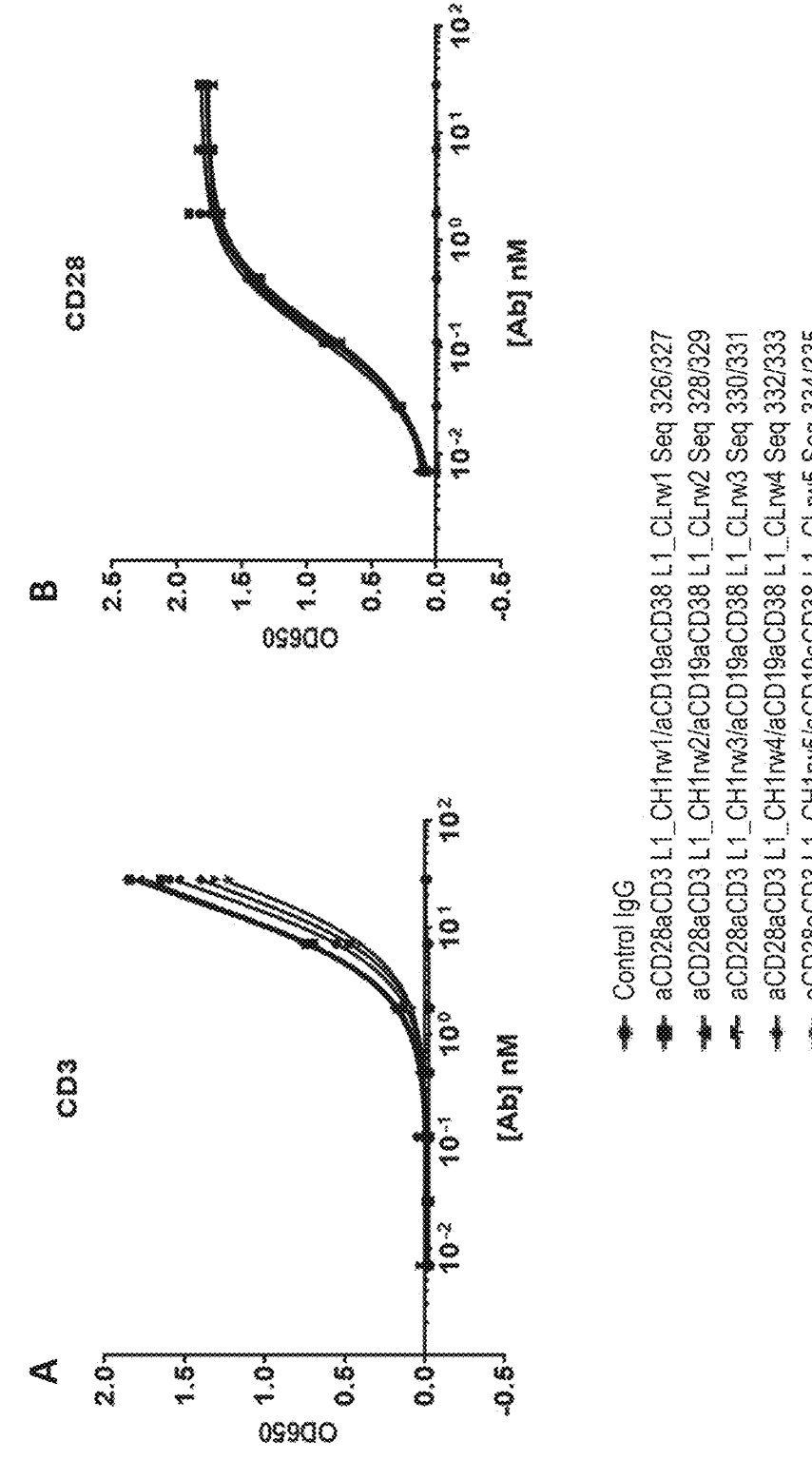
FIGS. 25A-25D show ELISA results of tetraspecific aCD28aCD3CH1/CD19CD38CL LALAPAFc with different linkers as depicted in FIG. 19B, or isotype control (Control IgG) binding to CD3 (FIG. 25A), CD28 (FIG. 25B), CD38 (FIG. 25C), and CD19 (FIG. 25D).
Figure 25:
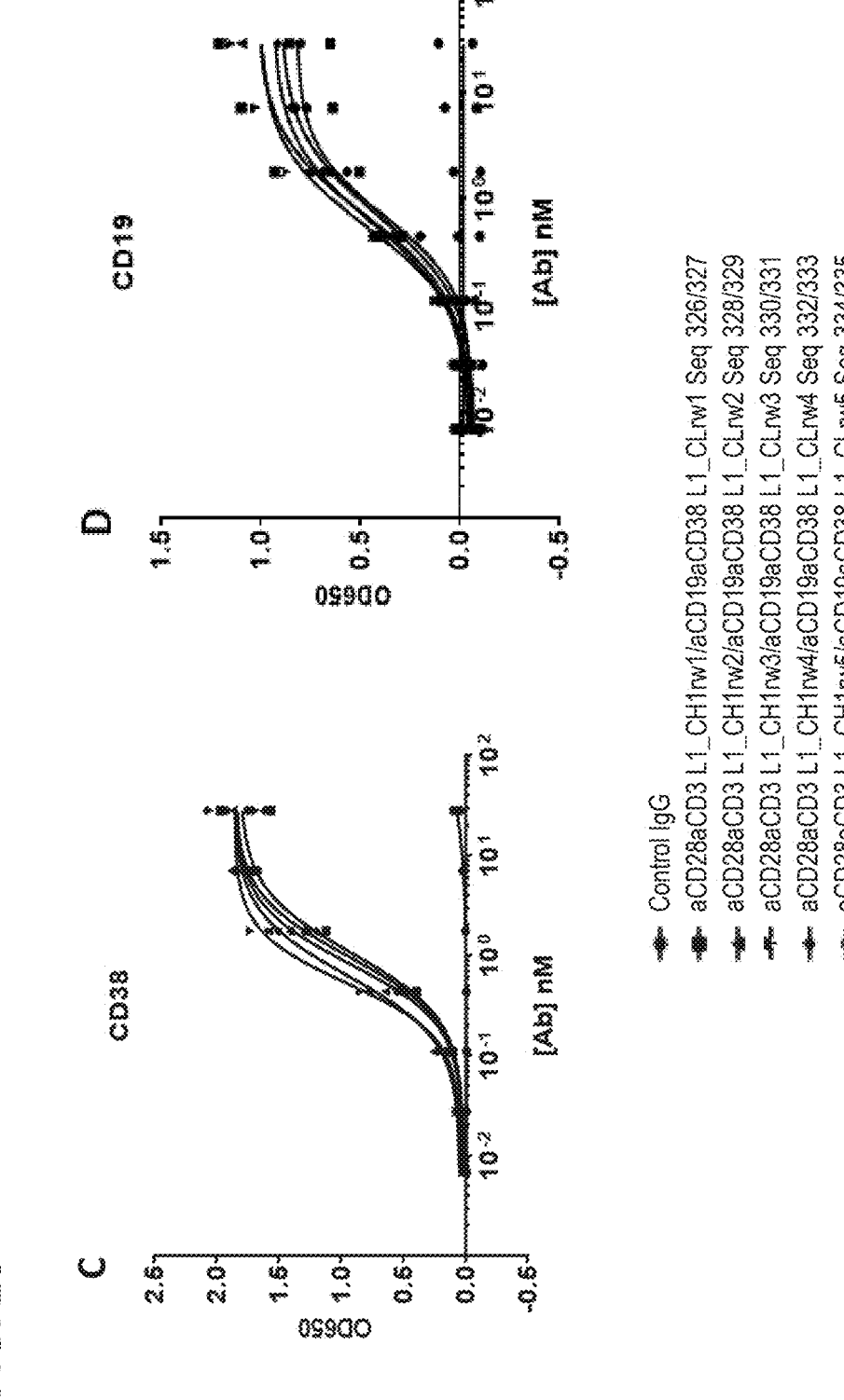

FIGS. 25A-25D show ELISA results of tetraspecific aCD28aCD3CH1/CD19CD38CL LALAPAFc with different linkers as depicted in FIG. 19B, or isotype control (Control IgG) binding to CD3 (FIG. 25A), CD28 (FIG. 25B), CD38 (FIG. 25C), and CD19 (FIG. 25D).

Figures 26A, 26B:
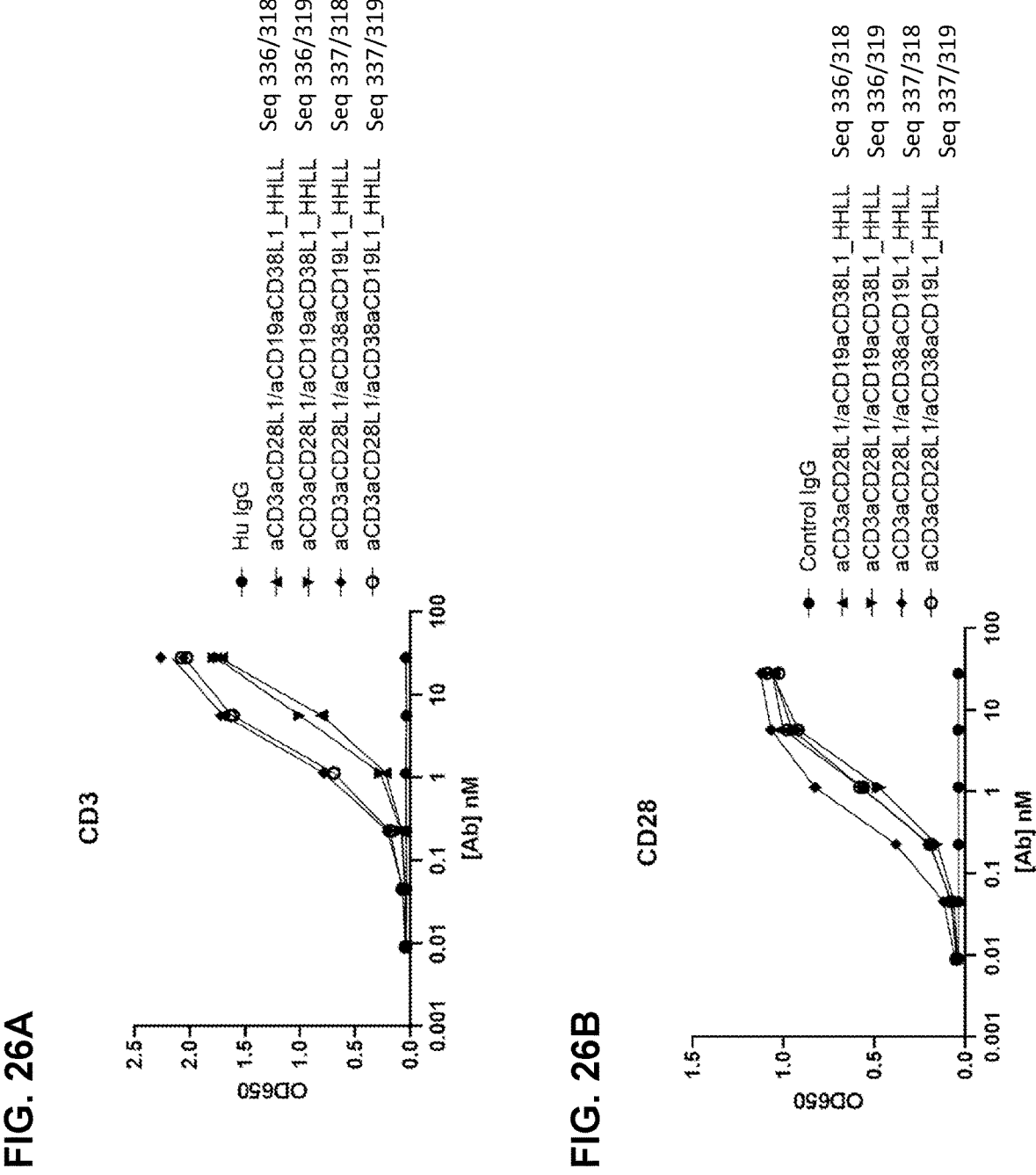
Figures 26E, 26F:
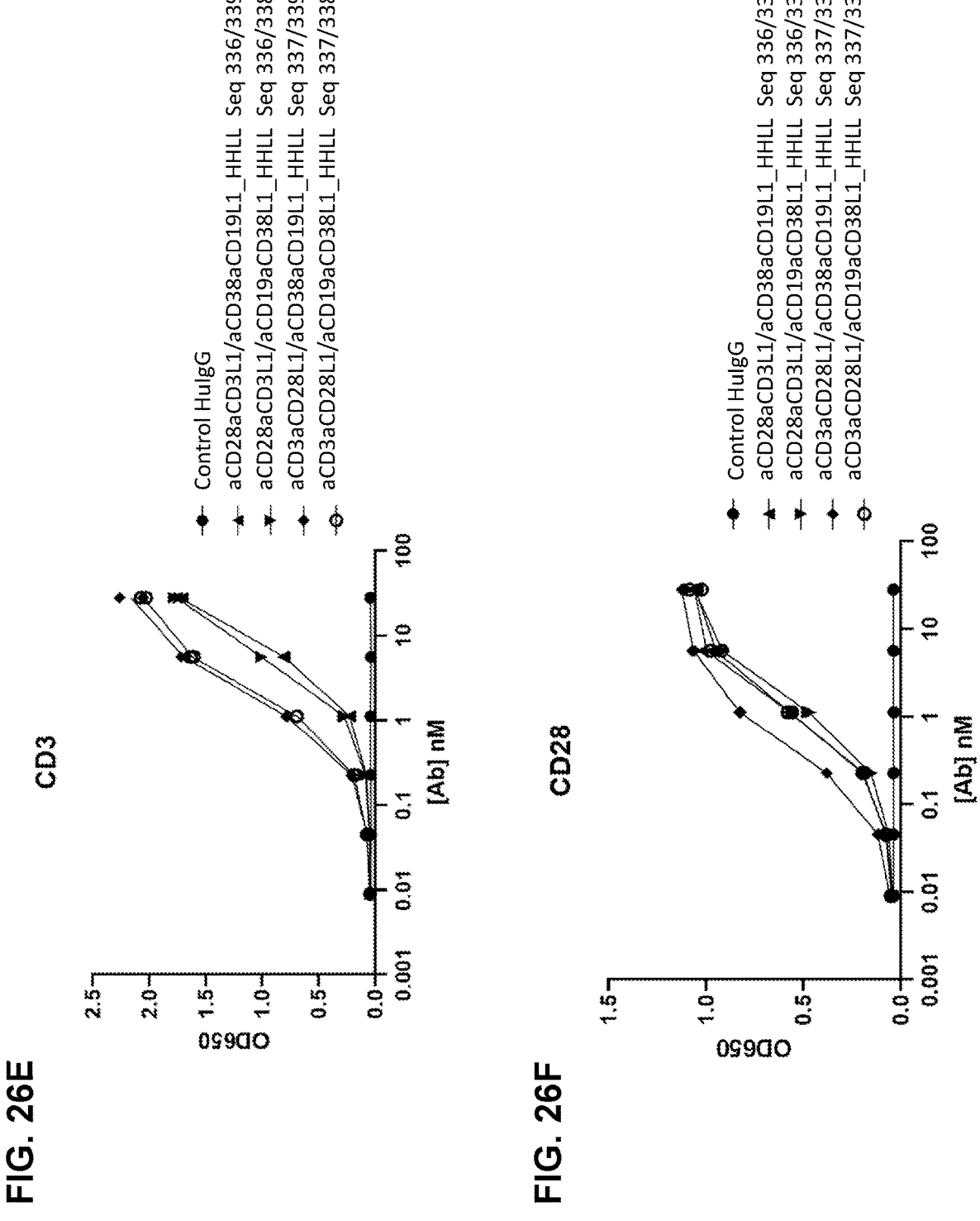
FIGS. 26E-26H show ELISA results of tetraspecific aCD28aCD3L1/aCD38aCD19L1_HHLL, aCD28aCD3L1/aCD19aCD38L1_HHLL, aCD3 aCD28L1/ aCD38aCD19L1_HHLL, aCD3aCD28L1/aCD19aCD38L1_HHLL, or isotype control (Control HuIgG) binding to CD3 (FIG. 26E), CD28 (FIG. 26F), CD38 (FIG. 26G), and CD19 (FIG. 26H).

FIGS. 26A-26D show ELISA results of tetraspecific aCD28aCD3CD38CD19LALAPAFc, aCD28aCD3CD38CD19LALAPAFc, aCD28aCD3CD38CD19LALAPAFc, or aCD3aCD28CD19CD38LALAPAFc, or isotype control (Control IgG) binding to CD3 (FIG. 26A), CD28 (FIG. 26B), CD38 (FIG. 26C), and CD19 (FIG. 26D).

Figures 26G, 26H:
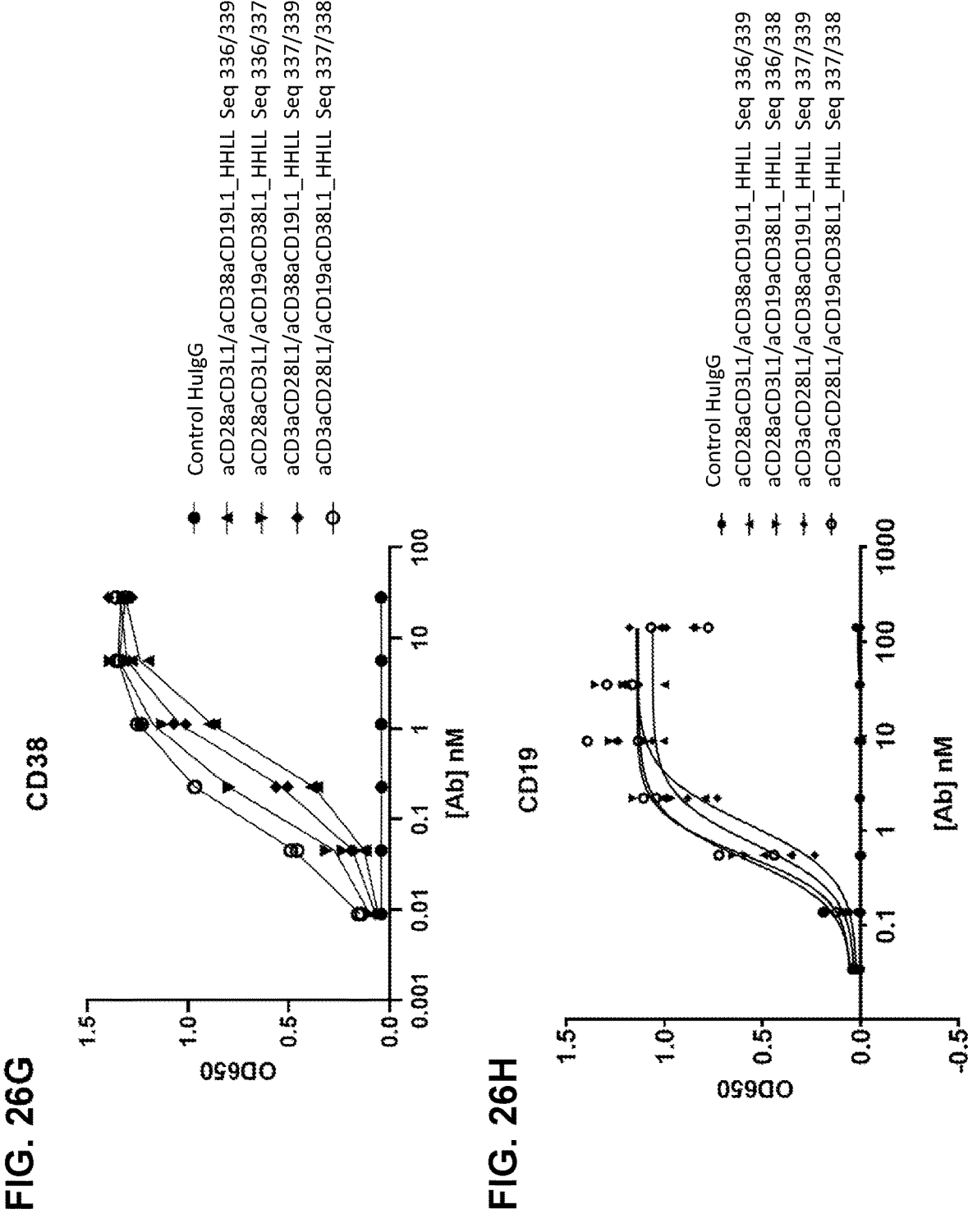
Figures 27A, 27B, 27C, 27D:
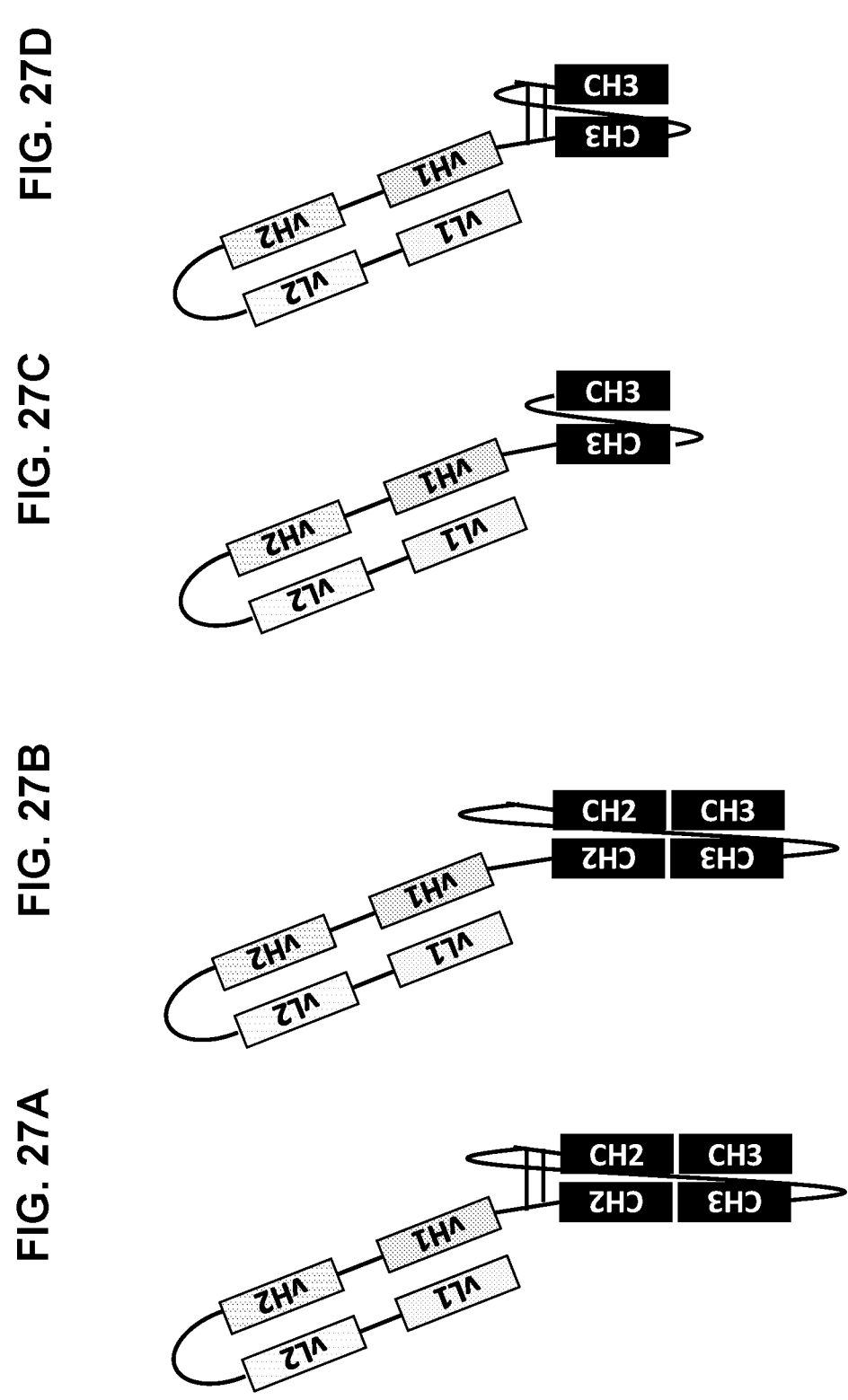

FIGS. 26E-26H show ELISA results of tetraspecific aCD28aCD3L1/aCD38aCD19L1_HHLL, aCD28aCD3L1/ aCD19aCD38L1_HHLL, aCD3aCD28L1/ aCD38aCD19L1_HHLL, aCD3aCD28L1/ aCD19aCD38L1_HHLL, or isotype control (Control HuIgG) binding to CD3 (FIG. 26E), CD28 (FIG. 26F), CD38 (FIG. 26G), and CD19 (FIG. 26H).

Example 9

T Cell Activation Assay

T cell activation by bispecific and tetraspecific antibodies was tested using an in vitro T cell activation assay. Purified human peripheral blood mononuclear cells (PBMCs, Blood Research Component, Brookline, MA, USA) were resuspended in culture medium (RPMI1640 with 10% FBS and supplemented with Penicillin Streptomycin)(Gibco) (2.5× $10^5$ cells/ml). Serial diluted bispecific, tetraspecific and control antibodies were first coated onto 96-well flat-bottom culture plates by incubating 2-4 hours in a 37° C. tissue culture incubator. PBMCs (200 µL) were then added to each well containing the antibodies and incubated for 16-24 hours in a 37° C. tissue culture incubator. The cells were centrifuged, stained with fluorescent labeled antibodies for T cell markers, such as CD3, CD4, CD8, activation marker CD69, and analyzed by an Attune flow cytometer (Thermo Fisher Scientific, USA). Data were analyzed using FlowJo software.

Figures 22A, 22B:
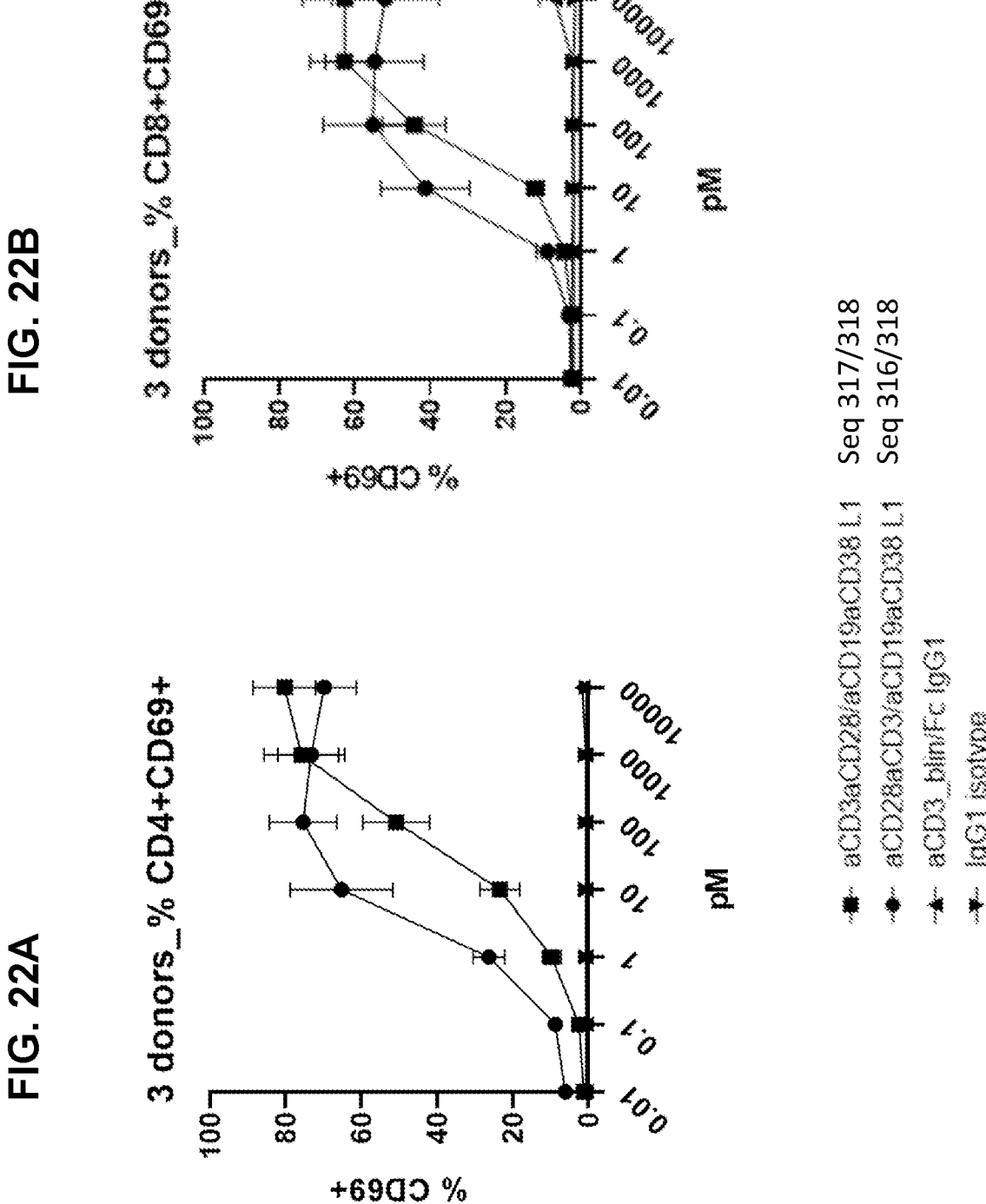
FIGS. 22A-22B show activation (CD69+) by tetraspecific molecules aCD28aCD3/aCD19CD38L1LALAPAFc or aCD3aCD28/CD19CD38L1LALAPAFc, or anti-CD3 mAb, of CD4+ (FIG. 22A) or CD8+ (FIG. 22B) T cells from three different donors.

FIGS. 22A-22B show activation (CD69+) by tetraspecific molecules aCD28aCD3/aCD19CD38L1LALAPAFc or aCD3aCD28/CD19CD38L1LALAPAFc, or anti-CD3 mAb, of CD4+(FIG. 22A) or CD8+(FIG. 22B) T cells from three different donors.

Example 10

NFkB Luciferase Reporter Assay

The function of bispecific and tetraspecific antibody constructs was further analyzed using a nuclear factor kappa B (NFkB) luciferase reporter assay. For this assay, Luciferase Reporter Jurkat Stable Cell Line (Signosis, CA, USA) and Jurkat-Lucia™ NFAT Cells (InvivoGen, CA, USA) were prepared according to manufacturer's protocol. Briefly, cells were thawed for 2 min in a 37° C. water bath and gently transferred to a 15 mL conical centrifuge tube containing 10 mL pre-warmed R10 media. Cells were pelleted at 300 g for 5 min at room temperature. After removing the supernatant, cells were resuspended in 20 mL pre-warmed culture media and transferred to a 75 cm² culture flask, followed by incubation in a mammalian tissue culture incubator until cells were growing and stable (~3-4 days). Cells were maintained in culture media+selective antibiotics and normally used 7 days after thawing.

For antibody stimulation, bispecific, tetraspecific or control antibodies were serially diluted in PBS and coated onto 96-well flat-bottom culture plates by incubating 2-4 hours in a 37° C. tissue culture incubator. NFkB Luciferase Reporter Jurkat Stable Cells were resuspended to 2×10⁶ cells/mL, with 100 µl of cells added to each well containing the antibodies and incubated in a mammalian incubator for 24 hours. Assay plates were then taken out and allowed to equilibrate to ambient temperature (10-15 min). Bio-Glo™ Reagent (Promega Cat #G7941) (ambient temperature) was added at 50 µl for each well of the assay plate. After 5 minutes, luminescence activity was measured using Varioskan microplate reader (Thermo Fisher). Data were plotted using GraphPad Prism software. Jurkat-Lucia™ NFAT Cells were resuspended to 7.5×10⁵ cells/mL, with 200 µl of cells added to each well containing the antibodies and incubated in a mammalian incubator for 24 hours. 20 uL of the cell culture supernatant was pipetted into a new 96-well white-walled microtiter plate. 50 uL of Quanti-Luc solution (InvivoGen) was then added to each well before luminescence activity was measured using Varioskan microplate reader (Thermo Fisher). Data were plotted using GraphPad Prism software.

Figure 17:
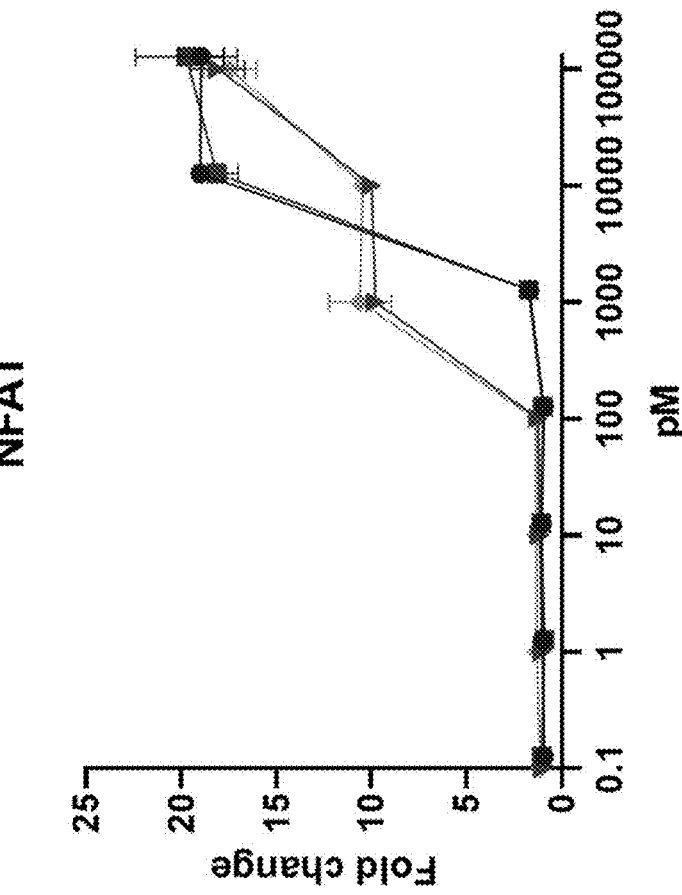
FIG. 17 shows nuclear factor of activated T-cells (NFAT) pathway activation by bispecific, tetravalent aCD28aCD3L1LALAPAFc or aCD3aCD28L1LALAPAFc, or anti-CD3 and anti-CD28 mAbs using NFAT promoter-luciferase expressing human Jurkat T cells.

FIG. 17 shows NFkB pathway activation by bispecific, tetravalent aCD28aCD3L1LALAPAFc or aCD3 aCD28L1LALAPAFc.

Figure 21:
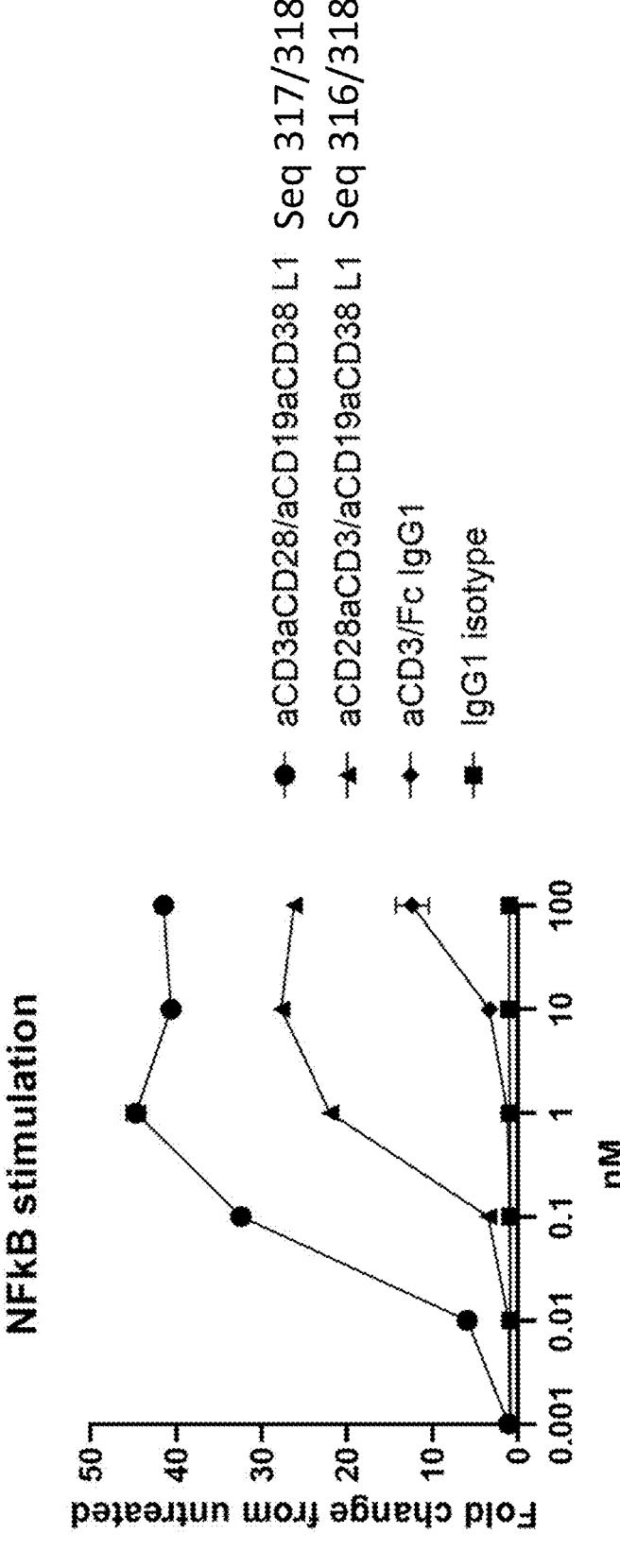
FIG. 21 shows NFκB pathway activation by tetraspecific aCD28aCD3/aCD19CD38L1LALAPAFc or aCD3aCD28/CD19CD38L1LALAPAFc, or anti-CD3 mAbs using NFκB promoter-luciferase expressing human Jurkat T cells.

FIG. 21 shows NFκB pathway activation by tetraspecific aCD28aCD3/aCD19CD38L1LALAPAFc or aCD3aCD28/CD19CD38L1LALAPAFc.

Example 11

Design of Trispecific Antibody Constructs

Non-limiting examples of additional trispecific antibody configurations are shown in FIGS. 28A-28E. Such examples include, but are not limited to, an antigen binding polypeptide complex comprising a first polypeptide having an amino acid sequence of SEQ ID NOs:98-118, and a second polypeptide having an amino acid sequence of SEQ ID NOs: 119-131.

Antibody heavy chain variable domain (VH) and light chain variable domain (VL) sequences targeting human CD3, CD28, CD38 and CD19 were selected from publicly available databases (e.g., GenBank) or patents to illustrate the feasibility of constructing various formats of trispecific antibodies. Linkers in various length and sequence connecting VH and VL regions in different orders and orientations were tested, with and without different motifs of the constant domains (e.g., CL, CH1, CH2, CH3). "Knob" and "hole" mutations were integrated into respective halves of the antibody Fc region when Fc heterodimerization was needed. Effector function or half-life extension mutations can also be incorporated into the Fc sequences when needed. Once the amino acid sequences for each trispecific antibody molecule were assembled, DNA encoding these sequences were codon optimized, synthesized (Cambridge Biologics, LLC, Brookline, MA), and cloned into a eukaryotic expression vector.

Example 12

Trispecific Antibody Expression and Purification

Trispecific antibodies were produced by transient transfection of expression plasmids into Expi293F cells at density of $2.5$-$3.0 \times 10^6$/ml using polyethylenimine (PEI; Poly science). Plasmid DNA and PEI were diluted in OPTi-MEM (LifeTech) separately and mixed later. The plasmid/PEI mixture, at a ratio of 1:3 (w:w), was added to the cell culture 10 minutes after mixing. Valproic acid and sodium propionate were added to final concentrations of 0.5 mM and 5 mM, respectively, 16-20 hours post transfection. Supernatant was harvested 5 days post transfection, and filtered through a 0.45 um filter. Trispecific antibodies were then purified first by affinity chromatography using Protein A resins in batch mode according to manufacturer's standard procedures. After antibodies were eluted using IgG elusion buffer (Thermo Fischer Scientific) from protein A, they were dialyzed into 10 mM Histidine (pH6.0)+25 mM NaCl overnight. Antibodies were further purified by size exclusion chromatography using Hiload 16/600 Superdex 200 PG or Superdex 200 Increase 10/300 GL (Cytiva Lifesciences). Fractions with the correct elusion profile were collected and concentrated for further characterization.

Example 13

Trispecific Antibody ELISA Binding Analysis

An ELISA binding assay was used to test binding of trispecific antibodies to their target antigens. Target protein for each binding site of the trispecific antibodies was coated in the wells of 96-well Immuno Plates (Thermo Fisher Scientific) overnight at 4° C. Coated plates were blocked using 5% skim milk+2% bovine serum albumin (BSA) in phosphate buffered saline (PBS)+0.25% Tween for one hour at room temperature, then washed three times with PBS+ 0.25% Tween 20. Serial diluted trispecific antibodies and control molecules were added to the plates and incubated at room temperature for 1 hr. Plates were washed three times with PBS+0.25% Tween 20, incubated with horseradish peroxidase (HPR) conjugated detection antibody for one hour at room temperature, washed again, and then developed with Peroxidase Substrate (KPL, Gaithersburg, MD, USA). After the reaction was terminated by adding 100) 11 of KPL TMB BlueSTOP solution, plates were read at $OD_{650}$ using a plate reader and data analyzed in GraphPad Prism.

FIGS. 29A-29C show ELISA results of trispecific aCD28aCD3/aCD38scFv, aCD28aCD3/aCD38Fab, aCD28aCD3/aCD38scFab, aCD28aCD3/aCD38CLCH1, or isotype control (Control IgG) binding to CD3 (FIG. 29A), CD28 (FIG. 29B), and CD38 (FIG. 29C).

FIGS. 32A-32D show ELISA results of trispecific aCD28aCD3CL1CH1/aCD38scFvCL, aCD28aCD3CL1CH1/aCD19scFvCL or isotype control (Control IgG) binding to CD3 (FIG. 32A), CD28 (FIG. 32B), CD19 (FIG. 32C), and CD38 (FIG. 32D).

Example 14

T Cell Activation Assay

T cell activation by trispecific antibodies was tested using an in vitro T cell activation assay. Purified human peripheral blood mononuclear cells (PBMCs, Blood Research Component, Brookline, MA, USA) were resuspended in culture medium (RPMI1640 with 10% fetal bovine serum (FBS) and supplemented with Penicillin Streptomycin) (Gibco) ($2.5 \times 10^5$ cells/ml). Serial diluted trispecific and control antibodies were first coated onto 96-well flat-bottom culture plates by incubating 2-4 hours in a 37° C. tissue culture incubator. PBMCs (200 μL) were then added to each well containing the antibodies and incubated for 16-24 hours in a 37° C. tissue culture incubator. The cells were centrifuged, stained with fluorescent labeled antibodies for T cell markers, such as CD3, CD4, CD8, activation marker CD69, and analyzed by an Attune flow cytometer (Thermo Fisher Scientific, USA). Data were analyzed using FlowJo software.

FIG. 30 shows the activation (CD69+) by trispecific antibodies aCD28aCD3L1/aCD38scFv, aCD3aCD28/ aCD38scFv, aCD28aCD3/aCD38scFab, aCD3aCD28/ aCD38scFab, PMA/IO positive or negative isotype (Control IgG) control, of CD2+ T cells from three different donors.

Example 15

In Vitro Cytolytic Assay

Cytolysis of lymphoma tumor cells Z-138 by T cells mediated by trispecific antibodies was determined using an in vitro cytolytic assay. PBMCs were isolated from normal human donors by Ficoll separation. Target lymphoma cancer cells Z-138 were labeled with the membrane dye PKH-26 (Sigma-Aldrich) and co-cultured for 16 h in a 37° C. tissue culture incubator with human PBMCs as effector cells at an effector-to-target (E:T) ratio of 10:1. Titrations of trispecific antibodies were added to the cells at the start of the incubation. After the incubation cells were spun down and then stained with Fixable Viability dye (Invitrogen). Cells were washed and then run on an Attune flow cytometer (Thermo Fisher Scientific, USA), followed by analysis using the FlowJo software. The percentage of killing is calculated by gating on PKH-26+ tumor cells and determining percentage of dying cells that stain positive for Fixable Viability dye.

FIGS. 31A-31C show cytolysis of lymphoma tumor cells by T cells mediated by trispecific antibodies aCD28aCD3L1/aCD38scFv, aCD3aCD28/aCD38scFv, aCD28aCD3/aCD38scFab, aCD3aCD28/aCD38scFab, PMA/IO or isotype (Control IgG) control from three different donors (FIGS. 31A-31C, respectively).

Example 16

Design of Additional Antibody Constructs

Non-limiting examples of additional antibody configurations are shown in FIG. 33. Such examples include, but are not limited to, an antigen binding polypeptide complex comprising a first polypeptide having an amino acid sequence of any one of SEQ ID NOs:132-155, and a second polypeptide having an amino acid sequence of any one of SEQ ID NOs:132-155.

Example 17

Design of Masked Multispecific Molecules

Non-limiting examples of masked tetraspecific antibody configurations are shown in FIGS. 34, 35 and 40. Such examples include, but are not limited to, an antigen binding polypeptide complex comprising two or three polypeptides, each having the sequence of any one of SEQ ID NOs:156-272. In FIG. 34, variable domains (Fv) of the antibody are shown as heavy chain/light chain pairs, with Fv1-Fv3 targeting tumor associated antigens (TAAs) or immune costimulatory receptors, and a fourth Fv targeting CD3 (αCD3 or aCD3). In some aspects, linkers between Fv3 and αCD3 contain one or more protease recognition sites. In some aspects, three of the Fvs target human Trop2 (aT-ROP2), cMet (acMET), and CD28 (aCD28) and a fourth Fv targets CD3. See FIGS. 35 and 40.

Antibody heavy chain variable domain (VH) and light chain variable domain (VL) sequences targeting human CD3, CD28, Trop2, and cMet were selected from publicly available databases (e.g., GenBank) or patents to illustrate the feasibility of constructing various formats of trispecific antibodies. Linkers in various length and sequence connecting VH and VL regions in different orders and orientations were tested, with and without different motifs of the constant domains (e.g., CL, CH1, CH2, CH3). "Knob" and "hole" mutations were integrated into respective halves of the antibody Fc region when Fc heterodimerization was needed. Effector function or half-life extension mutations can also be incorporated into the Fc sequences when needed. Once the amino acid sequences for each trispecific antibody molecule were assembled, DNA encoding these sequences were codon optimized, synthesized (Cambridge Biologics, LLC, Brookline, MA), and cloned into a eukaryotic expression vector.

Example 18

Expression and Purification of Masked and Non-Masked Multispecific Molecules Masked and non-masked antibodies were produced by transient transfection of expression plasmids into Expi293F cells at density of $2.5-3.0 \times 10^6$ per ml using PEI (Poly-science). Plasmid DNA and PEI were diluted in OPTi-MEM (LifeTech) separately and mixed later. The plasmid/PEI mixture, at a ratio of 1:3 (w:w), was added to the cell culture 10 minutes after mixing. Valproic acid and sodium propionate were added to final concentrations of 0.5 mM and 5 mM, respectively, 16-20 hours post transfection. Supernatant was harvested 5 days post transfection, and filtered through a 0.45 μm filter. Multispecific antibodies were then purified first by affinity chromatography using Protein A resins in batch mode according to manufacture's standard procedures. After antibodies were eluted using IgG elusion buffer (Thermo Fischer Scientific) from protein A, they were dialyzed into 10 mM Histidine (pH6.0)+25 mM NaCl overnight Antibodies were further purified by size exclusion chromatography using Hiload 16/600 Superdex 200 PG or Superdex 200 Increase 10/300 GL (Cytiva Lifesciences). Fractions with the correct elusion profile were collected and concentrated for further characterization.

Example 19

In Vitro Protease Treatment of Masked Multispecific Molecules

Purified masked multispecific molecules at 1 ug/ml were incubated with 0.2 μg/ml activated Matriptase (MTP) (R & D systems, Cat #3946-SEB) or 0.4 μg/ml MMP9 (R & D system, Cat #911_MP) at 37° C. for 4 hours. 2 μg of digested proteins were run on SDS-PAGE.

FIG. 35 shows SDS-PAGE results of in vitro cleavage of exemplary masked tetraspecific molecules as depicted. Molecules were treated with either MTP or MMP9 protease as specified. GS:non-cleavable linker sequences are on both light chain (LC) and heavy chain (HC). LC_mmp:MMP2 sensitive linker sequences are on LC, and non-cleavable linker sequences are on HC. HC_mtp:MTP sensitive linker sequences are on HC, and non-cleavable linker sequences are on LC.

Example 20

ELISA Binding Analysis of Masked and Non-Masked Multispecific Molecules

An ELISA binding assay was used to test binding of multispecific molecules to their target antigens. Target protein for each binding site of the multispecific molecules was coated in the wells of 96-well Immuno Plate (Thermo Fisher Scientific) overnight at 4° C. Coated plates were blocked using 5% skim milk+2% BSA in PBS+0.25% Tween for one hour at room temperature, then washed with PBS+0.25% Tween 20 for three times. Serial diluted multispecific molecules and control molecules were added to the plate and incubated at room temperature for 1 hour. Plates were washed three times with PBS+0.25% Tween 20, incubated with HPR conjugated detection antibody for one hour at room temperature, washed again, and then developed with Peroxidase Substrate (KPL, Gaithersburg, MD, USA). After the reaction was terminated by adding 100 μl of KPL TMB BlueSTOP solution, the plate was read at $OD_{650}$ using a plate reader and data analyzed in GraphPad Prism.

FIG. 36 shows ELISA binding results of exemplary masked tetraspecific molecules as depicted in FIG. 35, or negative isotype (Control IgG1), with or without protease treatment. Molecules cleaved or not cleaved by MTP or MMP9 as specified were tested for binding affinity to Trop2 and cMet. Affinities to these two targets were not affected by protease treatment.

FIG. 37 shows ELISA binding results of exemplary masked tetraspecific molecules as depicted in FIG. 35, or negative isotype (Control IgG1), with or without protease treatment. Molecules cleaved or not cleaved by MTP or MMP9 as specified were tested for binding affinity to CD28. Affinities to these two targets were not affected by protease treatment.

FIG. 38 shows ELISA binding results of exemplary masked tetraspecific molecules as depicted in FIG. 35, or negative isotype (Control IgG1), with or without protease treatment. Molecules cleaved or not cleaved by MTP or MMP9 as specified were tested for binding affinity to CD3.

FIG. 40 shows ELISA binding results of exemplary non-masked tetraspecific molecules as depicted, or negative isotype (hIgG1LALPA) control, to their respective targets of hTrop2, hcMet, hCD28, and hCD3.

Example 21

T Cell Activation Assay

T cell activation by multispecific molecules was tested using an in vitro T cell activation assay. Purified human PBMCs (Blood Research Component, Brookline, MA, USA) were resuspended in culture medium (RPMI1640 with 10% FBS and supplemented with Penicillin Streptomycin) (Gibco) ($2.5\times10^5$ cells/ml). Serial diluted multispecific and control molecules were first coated onto 96-well flat-bottom culture plates by incubating for 2-4 hours in a 37° C. tissue culture incubator. PBMCs (200 μL) were then added to each well containing the molecules and incubated for 16-24 hours in a 37° C. tissue culture incubator. The cells were spun down, stained with florescent labeled antibodies for T cell activation marker CD69, and analyzed by an Attune flow cytometer (Thermo Fisher Scientific, USA). Data was analyzed using FlowJo software.

Figure 41:
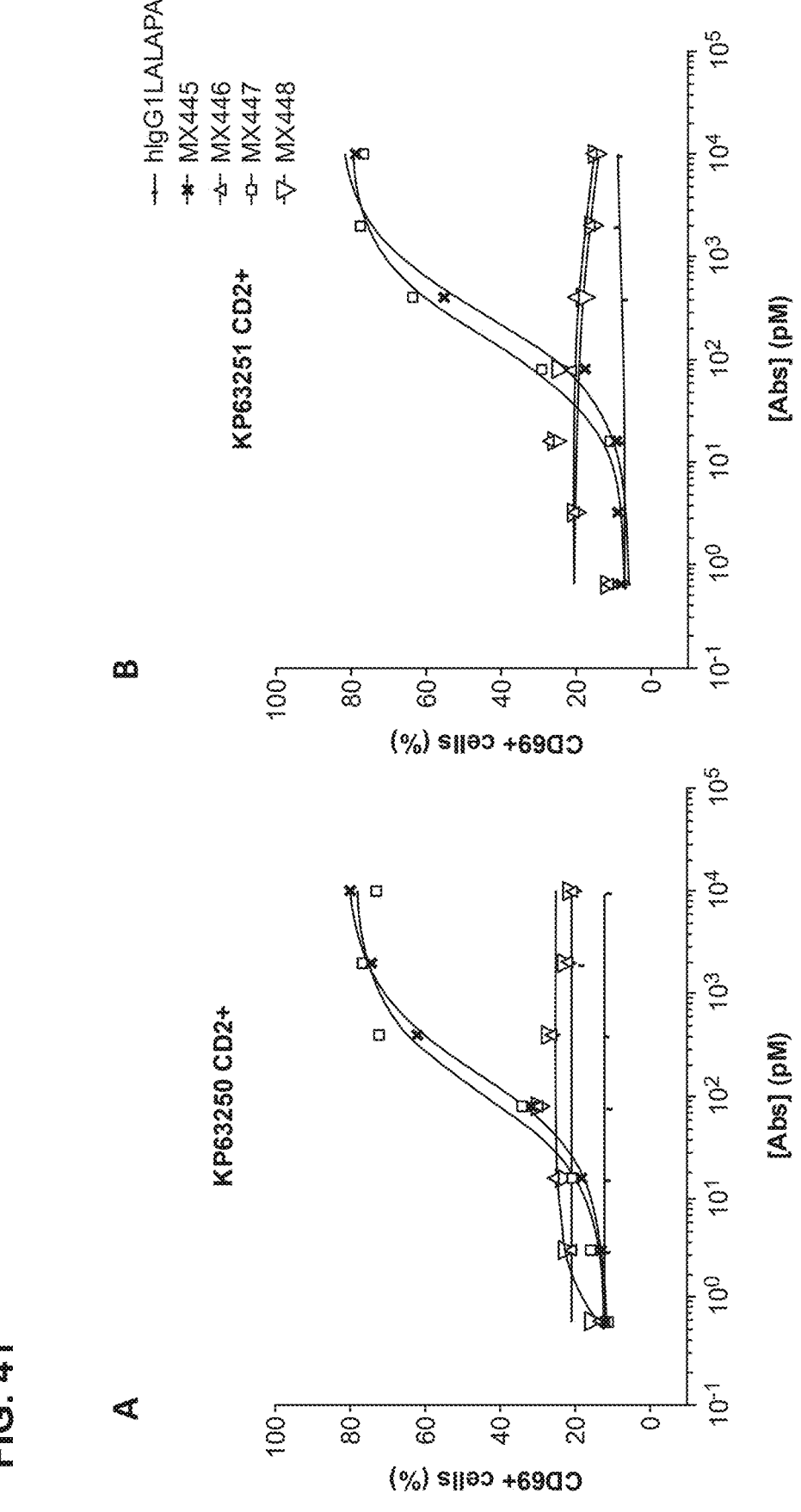

FIG. 41 shows CD69+ activation by exemplary non-masked tetraspecific molecules, or negative isotype (IgG1LALPA) control, of CD2+ T cells from PBMCs of two different donors.

Example 22

In Vitro Cytolytic Assay

Cytolysis of lymphoma tumor cells Z-138 by T cells mediated by trispecific antibodies was determined using an in vitro cytolytic assay. PBMCs were isolated from normal human donors by Ficoll separation. In vitro cytotoxicity assay was real-time monitored of cellular phenotypic changes by measurement of electrical impedance using the Agilent×CELLigence RTCA MP system. The system measures impedance using interdigitated microelectrodes integrated into the bottom of each well of the tissue culture E-Plates 96. Briefly, tumor cell HCC1954 were seeded into an E-plate 96 as target cells (T) at 20K/well culture at 37° C. for overnight, followed by the addition of human PBMC cells as immune effector cells (E) at 200K/well, in the presence of the 5-fold serially diluted multispecific antibody or human IgG1 isotype control. Cell impedance (measured as the cell index) was normalized when the effector cells were added and monitored continuously every 30 min for a duration of up to 160 hours. The cytotoxicity was calculated as Lysis %=100−(experimental normalized cell index/average of control antibody group normalized cell index at same concentration)×100.

Figure 39:
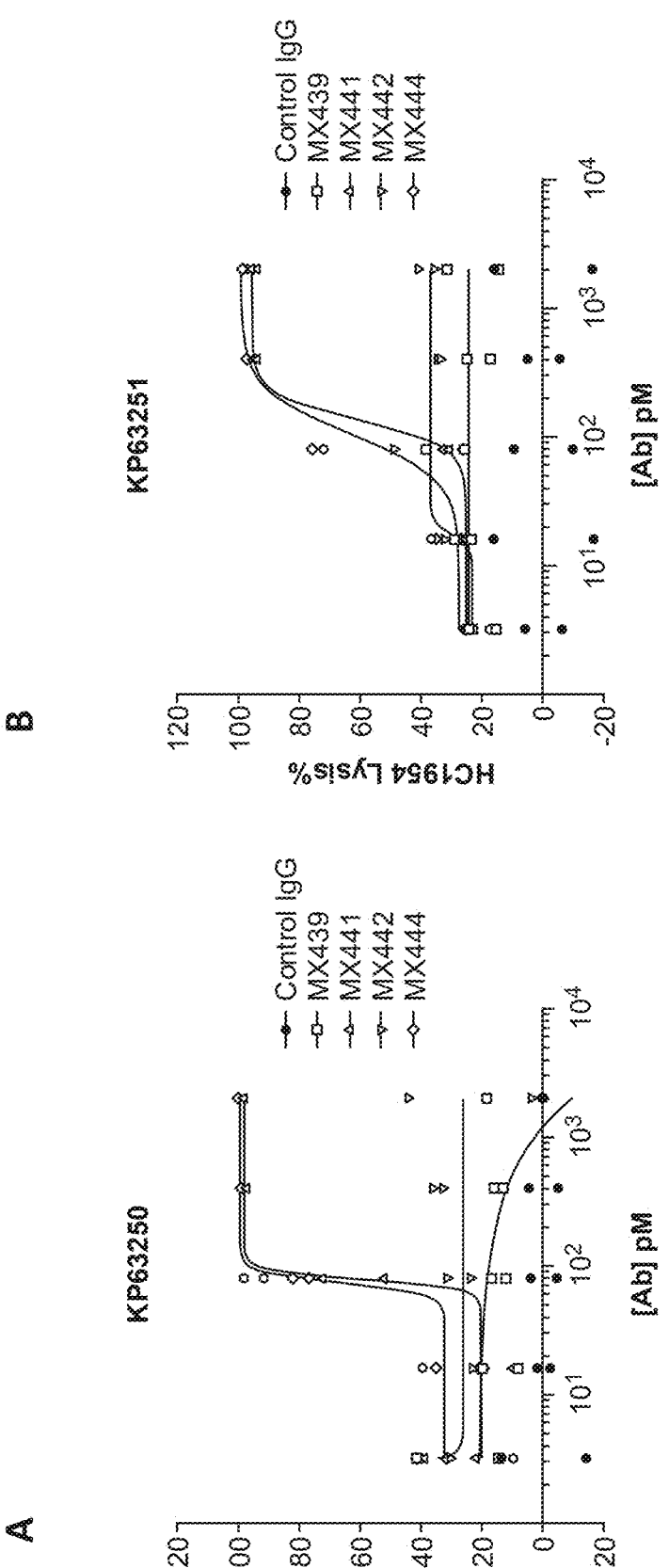

FIG. 39 shows cytolysis of HCC1954 tumor cells by PBMCs (E:T:10:1) mediated by exemplary masked tetraspecific molecules as depicted in FIG. 35, or negative isotype (Control IgG1), from PBMCs of two donors (KP63250 and KP63251).

Example 23

Design of Additional Antibody Constructs

A further non-limiting example of an additional antibody configuration is shown in FIG. 42. Variable domains (Fv) of the antibody are shown as heavy chain/light chain pairs, along with Fc domain. Also shown (TNF) is a trimer of extracellular domains of a tumor necrosis factor superfamily (TNFSF) ligand (e.g., 4-1BBL or OX-40L). TNF can be present on both arms of the antibody (shown in FIG. 33) or present on one arm and not the other. This example includes, but is not limited to, an antigen binding polypeptide complex comprising a first polypeptide having an amino acid sequence of any one of SEQ ID NOs:273-309, and a second polypeptide having an amino acid sequence of any one of SEQ ID NOs:273-309.

Example 24

BLI and Flow Cytometry Analysis of Additional Antibody Constructs

A further non-limiting example of a tetravalent, bispecific antibody configuration is shown in FIG. 43A, called MX846 (SEQ ID NOs:631-634). Other examples that were made include MX847 (SEQ ID NOs:635-638), MX850 (SEQ ID NOs:639-642), MX852 (SEQ ID NOs:647-650), and MX854 (SEQ ID NO:655-658). MX846 was analyzed for binding to CD3 by biolayer interferometry (BLI) (FIG. 43B), and to CD20 by flow cytometry (FIG. 43C) as follows. Binding Kinetic Analyses by Biolayer Interferometry On the Octet® R8 (Sartorius), recombinant His-tagged CD3, BMCA, or CD28 was loaded by His-tag capture onto HIS1K biosensors (100 nM ligand, 300 seconds, 1000 RPM). After baseline step (100 seconds, 1000 RPM), association with each test molecule (100 nM analyte) was monitored (300 seconds, 1000 RPM). Dissociation was then monitored (300 seconds, 1000 RPM).

All assay steps occurred in 1× kinetic buffer (1×PBS pH7.4; 0.1% BSA; 0.02% Tween-20) at 24 degrees C. Prior to each kinetic cycle, the HIS1K biosensors were regenerated in 1.5 pH glycine (5 seconds, 1000 RPM) and neutralized in 1× kinetic buffer (5 seconds, 1000 RPM) 5 consecutive times and then equilibrated back to 1× kinetic buffer (100 seconds; 1000 RPM).

Binding model fit assumed a 1:1 binding model and fit the association and dissociation together. Baseline was determined by mean of last five seconds of baseline step. In Vitro Cell Surface Binding by Flow Cytometry Expi293 cells transfected hCD20 were seeded in 96 U-bottom plate at 1×10e5 cells/well. The TASER antibody or human IgG1 isotype control were added at final concentration 1-10 μg/ml and incubated on ice or at 4° C. for 20-30 minutes. Then, cells were spun down and stained with anti-human Fc PE (Jackson Immuno Research Cat #109-115-098) and viability dye (Invitrogen Cat #65-0864-14). Stained cells were analyzed by flow cytometry and the binding ability were presented as PE positive population among total live cells.

The results in FIGS. 43B and 43C show that MX846 bound to CD3 and CD20.

Example 25

BLI and Flow Cytometry Analysis of Additional Antibody Constructs

A further non-limiting example of a tetravalent, trispecific antibody configuration is shown in FIG. 44A, called MX855 (SEQ ID NOs:659-662). MX855 was analyzed for binding to CD3 and CD28 by biolayer interferometry (BLI) (FIG. 44B), and to CD20 by flow cytometry (FIG. 44C), using the methods explained above. The results in FIGS. 44B and 44C show that MX855 bound to CD3, CD28 and CD20.

Example 26

BLI and Flow Cytometry Analysis of Additional Antibody Constructs

A further non-limiting example of a tetraspecific antibody configuration is shown in FIG. 45A, called MX851 (SEQ ID NOs:643-646). MX851 was analyzed for binding to CD3, CD28 and BCMA by biolayer interferometry (BLI) (FIG. 45B), and to CD20 by flow cytometry (FIG. 45C), using the methods explained above. The results in FIGS. 45B and 45C show that MX851 bound to CD3, CD28, BCMA and CD20.

Example 27

BLI and Flow Cytometry Analysis of Additional Antibody Constructs

A further non-limiting example of a tetraspecific antibody configuration is shown in FIG. 46A, called MX853 (SEQ ID NOs:651-654). MX853 was analyzed for binding to CD3, CD28 and BCMA by biolayer interferometry (BLI) (FIG. 46B), and to CD20 by flow cytometry (FIG. 46C), using the methods explained above. The results in FIGS. 46B and 46C show that MX853 bound to CD3, CD28, BCMA and CD20.

Example 28

Killing of Mantle Cell Lymphoma with Additional Antibody Constructs

In vitro killing of Z-138 tumor cells by T cells mediated by tetravalent, tetraspecific MX851 and tetravalent, trispecific MX855 was analyzed. B-lymphoma Z-138 was pre-labeled with PKH26 (Sigma Cat #PKH26GL-1KT) and seeded into a 96-well U-bottom plate as target cells (T) at 20K/well), in the presence of the 5-fold serially diluted TASER antibody or human IgG1 isotype control (hIgG1LALAPA). Human Pan-T cells isolated from healthy donor PBMC with Dynabeads® Untouched™ Human T Cells kit (Invitrogen Cat #11344D) were added as immune effector cells (E) at 60K/well (E:T=3:1) and incubated at 37° C. for 24-48 hours. The cells were spun down and stained with Viability Dye eFluor™ 660 (Invitrogen Cat #65-0864-14) after incubation. Stained cells were analyzed by flow cytometry for live cell counts. The cytotoxicity was calculated as Lysis %=100−(experimental live cell number/average of control antibody group live cell number at same concentration)*100.

The results in FIGS. 47A-47B show that both MX851 (FIG. 47A) and MX855 (FIG. 47B) mediated killing of Z-138 tumor cells.

Example 29

BLI Analysis of Additional Antibody Constructs

A further non-limiting example of a trispecific antibody configuration is shown in FIG. 48A, called MX894 (SEQ ID NOs:663-666; VRC01scFv/PGT121x10e8v4L1IgG1LS). MX894 was analyzed for binding to 10e8 fusion peptide, and CD4 site-dependent and CD4 site-independent HIV spike protein by biolayer interferometry (BLI) as follows. Binding Kinetic Analyses by Biolayer Interferometry On the Octet® R8 (Sartorius), recombinant His-tagged HIV RCS3, HIV gp140ΔCD4, or HIV 10e8 peptide was loaded by His-tag capture onto HIS1K biosensors (100 nM ligand, 300 seconds, 1000 RPM). After baseline step (100 seconds, 1000 RPM), association with each test molecule as indicated (100 nM analyte) was monitored (300 seconds, 1000 RPM). Dissociation was then monitored (300 seconds, 1000 RPM).

All assay steps occurred in 1× kinetic buffer (1×PBS pH7.4; 0.1% BSA; 0.02% Tween-20) at 24 degrees C. Prior to each kinetic cycle, the HIS1K biosensors were regenerated in 1.5 pH glycine (5 seconds, 1000 RPM) and neutralized in 1× kinetic buffer (5 seconds, 1000 RPM) 5 consecutive times and then equilibrated back to 1× kinetic buffer (100 seconds; 1000 RPM).

Binding model fit assumed a 1:1 binding model and fit the association and dissociation together. Baseline was determined by mean of last five seconds of baseline step.

Figures 48C, 48D:
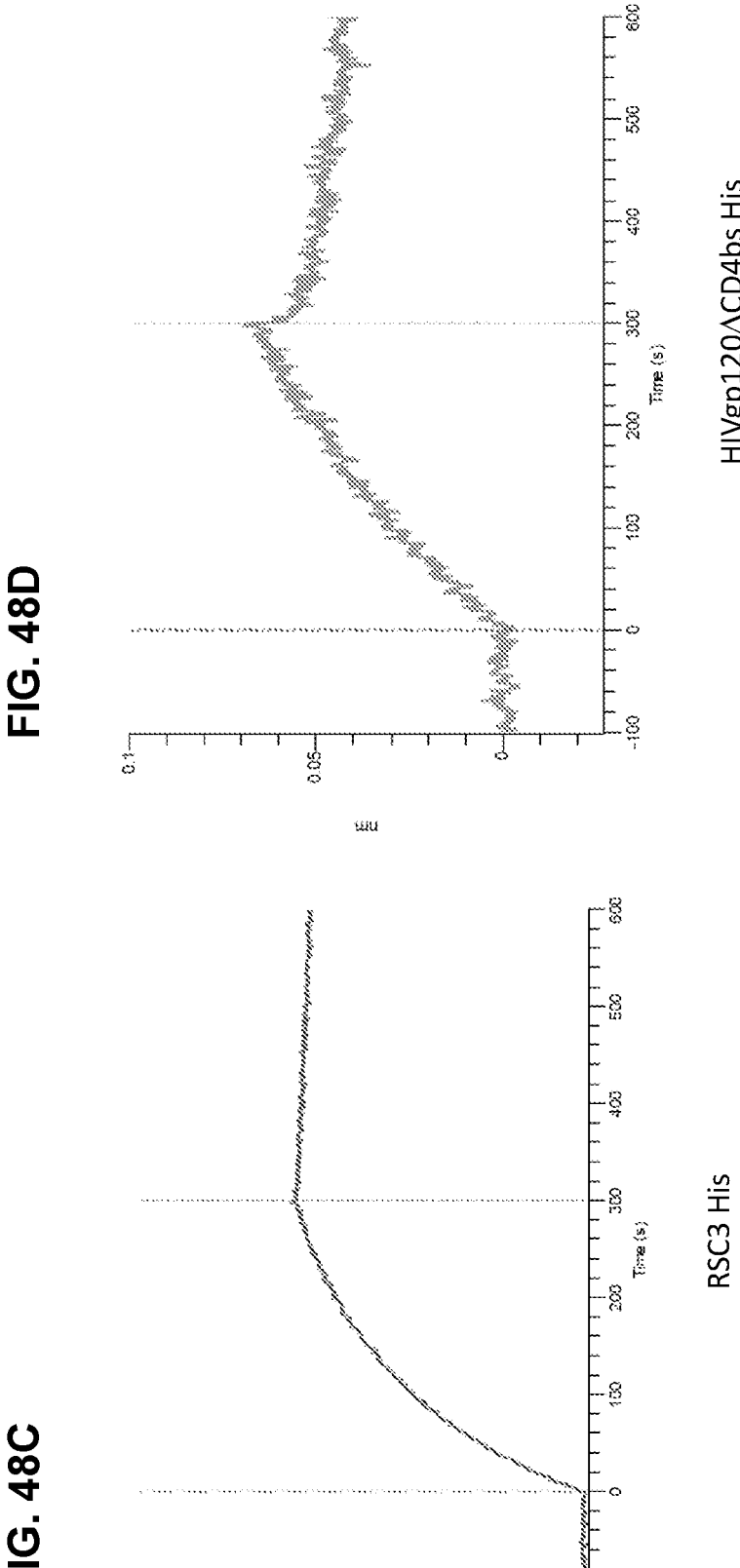

The results in FIGS. 48B-48D show that MX894 bound to 10e8 fusion peptide (FIG. 48B), and CD4 site-dependent (FIG. 48C) and CD4 site-independent (FIG. 48D) HIV spike protein.

Example 30

BLI Analysis of Additional Antibody Constructs

A further non-limiting example of a tetraspecific antibody configuration is shown in FIG. 49A, called MX873 (SEQ ID NOs:667-670; VRC26.25×10-1074L9/VRC01×PGT121L1 IgG1LS). MX873 was analyzed for binding to CD4 site-dependent and CD4 site-independent HIV spike protein by biolayer interferometry (BLI) as described above.

Figure 49C:
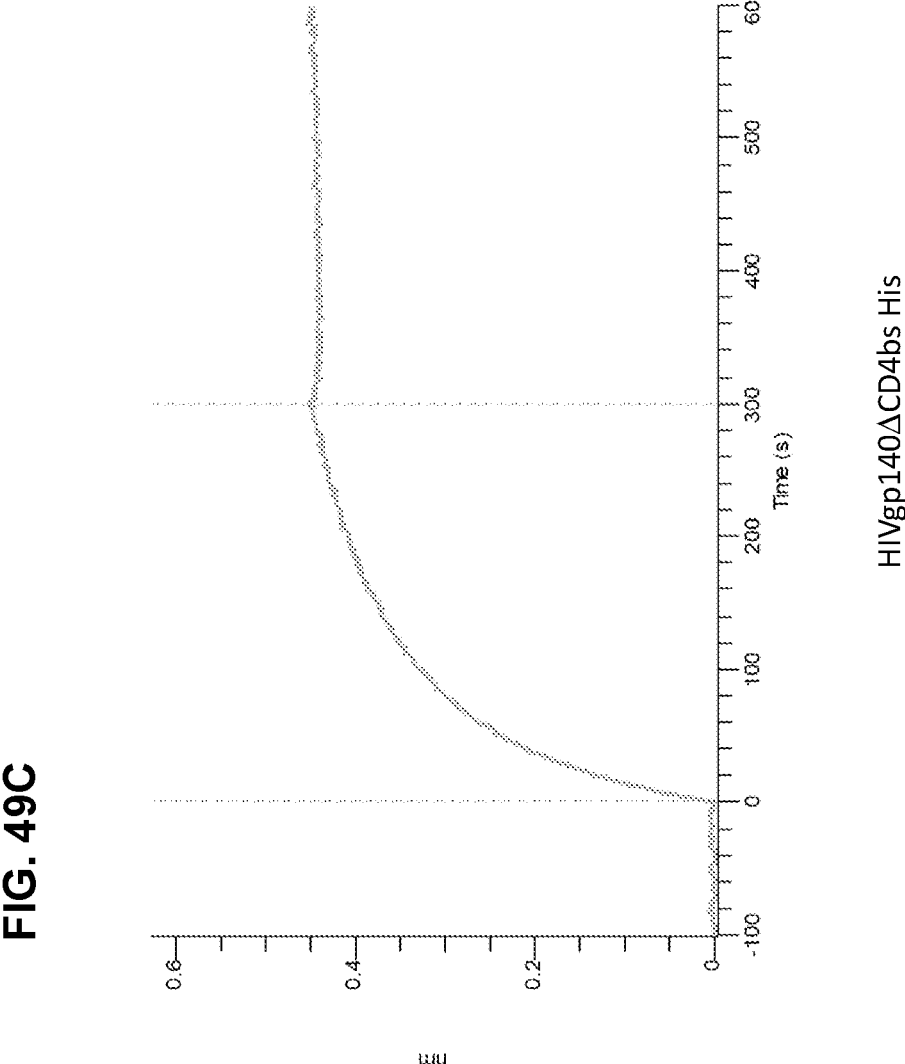

The results in FIGS. 49B-49C show that MX873 bound to CD4 site-dependent (FIG. 49B) and CD4 site-independent (FIG. 42C) HIV spike protein.

Example 31

BLI Analysis of Additional Antibody Constructs

A further non-limiting example of a tetraspecific antibody configuration is shown in FIG. 50A, called MX875 (SEQ ID NOs:671-674; 10-1074×VRC26.25L9/VRC01×PGT121L1 IgG1LS). MX875 was analyzed for binding to CD4 site-dependent and CD4 site-independent HIV spike protein by biolayer interferometry (BLI) as described above.

Figure 50C:
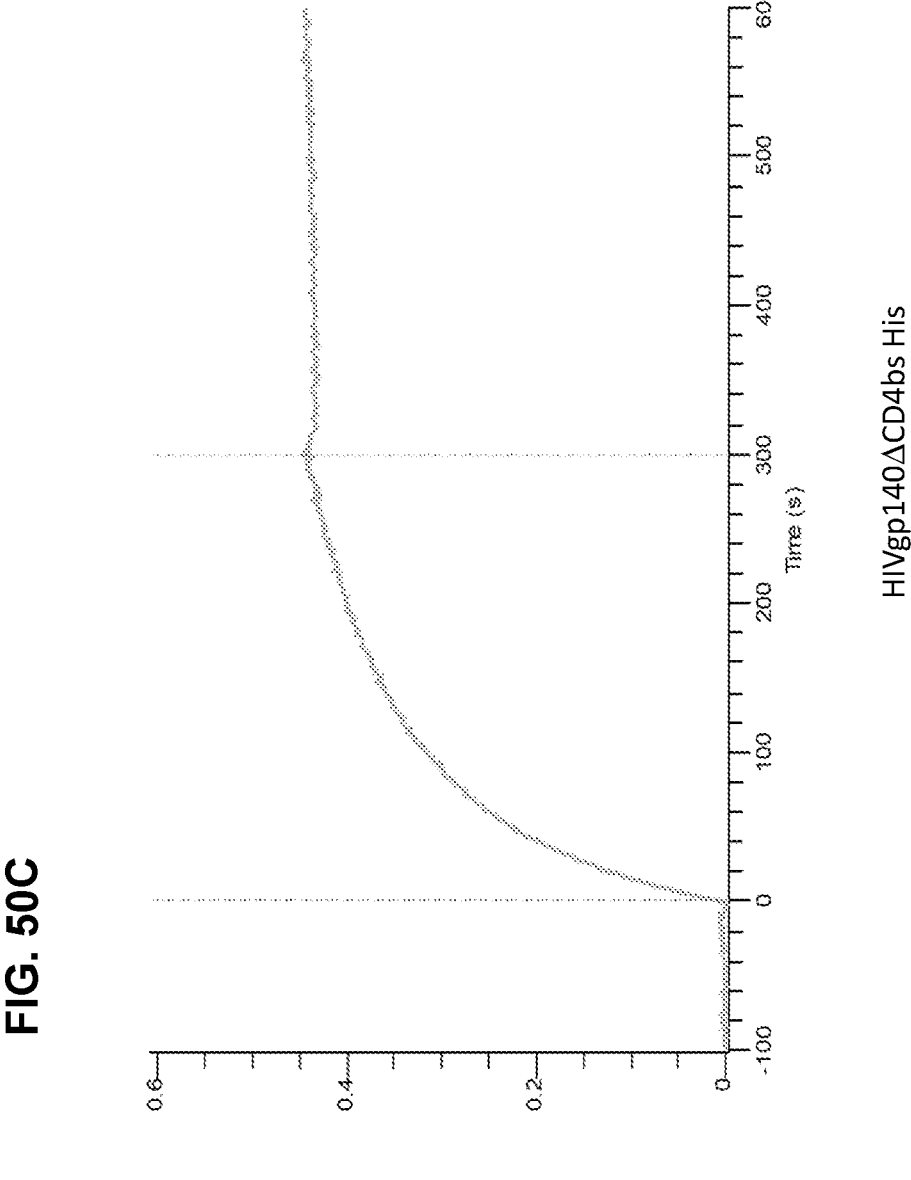

The results in FIGS. 50B-50C show that MX875 bound to CD4 site-dependent (FIG. 50B) and CD4 site-independent (FIG. 50C) HIV spike protein.

Example 32

BLI Analysis of Additional Antibody Constructs

A further non-limiting example of a tetraspecific antibody configuration is shown in FIG. 51A, called MX877 (SEQ ID NOs:675-678; STAR_VRC26.25×PGT128L9/ STAR_VRC01×PGT121L1 IgG1LS). MX877 was analyzed for binding to CD4 site-dependent and CD4 site-independent HIV spike protein by biolayer interferometry (BLI) as described above.

Figure 51C:
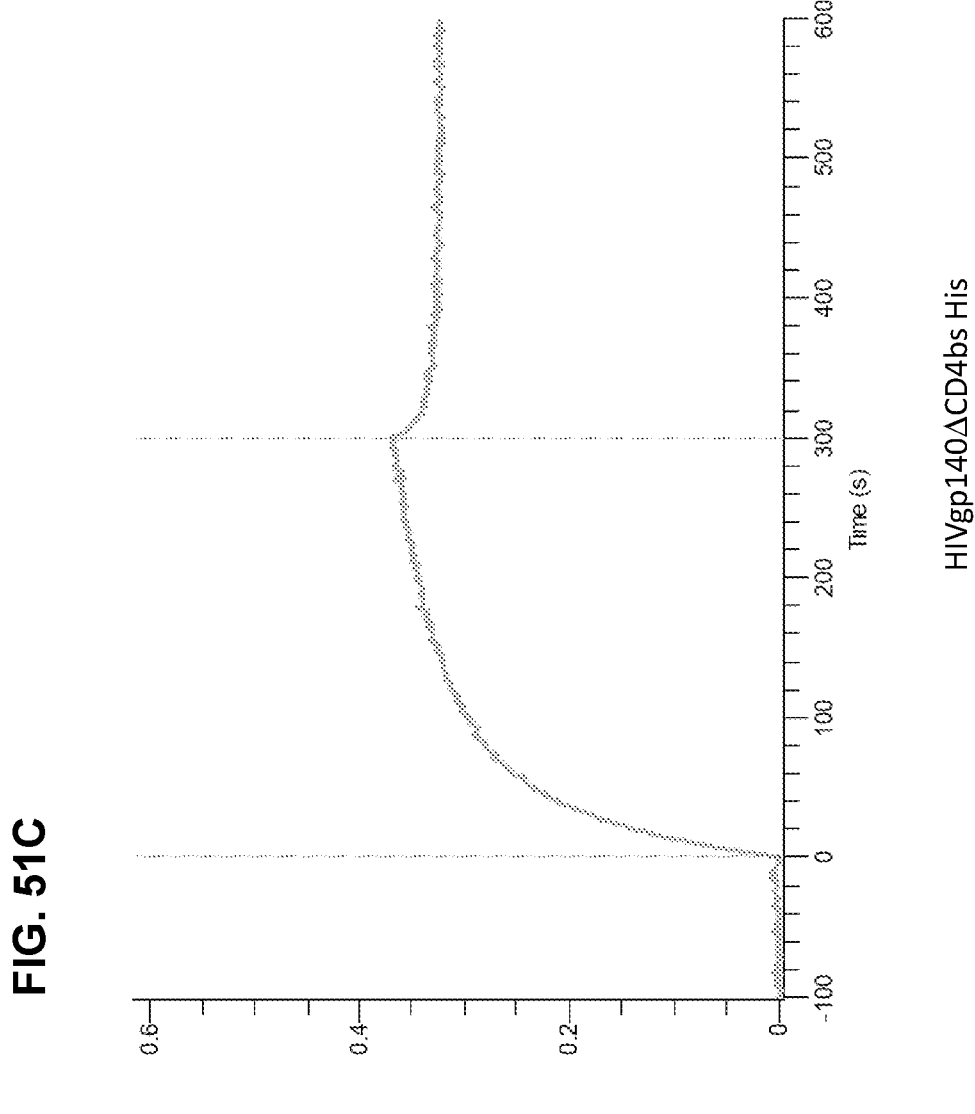

The results in FIGS. 51B-51C show that MX877 bound to CD4 site-dependent (FIG. 51B) and CD4 site-independent (FIG. 51C) HIV spike protein.

All publications, patents and patent applications mentioned in this application are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (686 sequences)

SEQ ID NO: 1 - protein, 5 aa, synthetic construct
  REGION 1..5: note = Linker
GGSSG

SEQ ID NO: 2 - protein, 5 aa, synthetic construct
  REGION 1..5: note = Linker
GSSGS

SEQ ID NO: 3 - protein, 5 aa, synthetic construct
  REGION 1..5: note = Linker
GTVAA

SEQ ID NO: 4 - protein, 5 aa, synthetic construct
  REGION 1..5: note = Linker
ASGGS

SEQ ID NO: 5 - protein, 5 aa, synthetic construct
  REGION 1..5: note = Linker
ASTGG

SEQ ID NO: 6 - protein, 6 aa, synthetic construct
  REGION 1..6: note = Linker
ASGGSG

SEQ ID NO: 7 - protein, 10 aa, synthetic construct
  REGION 1..10: note = Linker
GGSGGSSGSS

SEQ ID NO: 8 - protein, 10 aa, synthetic construct
  REGION 1..10: note = Linker
SGGSGSSGGS

SEQ ID NO: 9 - protein, 17 aa, synthetic construct
  REGION 1..17: note = Linker
GGSGGSGSGGGSASGSG

SEQ ID NO: 10 - protein, 18 aa, synthetic construct
  REGION 1..18: note = Linker
GGSGGSGSGGGGSASGSG

SEQ ID NO: 11 - protein, 20 aa, synthetic construct
  REGION 1..20: note = Linker
GGGSSGGGGSGGSGSGGSGS

SEQ ID NO: 12 - protein, 20 aa, synthetic construct
  REGION 1..20: note = Linker
GGGGSGGSGSGGGGSASGSG

SEQ ID NO: 13 - protein, 20 aa, synthetic construct
  REGION 1..20: note = Linker
GGGSSGGSGSGGSGSGGSGS

SEQ ID NO: 14 - protein, 22 aa, synthetic construct
  REGION 1..22: note = Linker
SGGSSGGSGSGGSGSGGSGSSG

SEQ ID NO: 15 - protein, 22 aa, synthetic construct
  REGION 1..22: note = Linker
GSGSSGGGGSGGSGSGGSGSSG

SEQ ID NO: 16 - protein, 40 aa, synthetic construct
  REGION 1..40: note = Linker
GGGGSGSGGSGGGSSGGGGSGGGGSGGGGSGGGGSGGGGS

SEQ ID NO: 17 - protein, 40 aa, synthetic construct
  REGION 1..40: note = Linker
GGGGSGGGGSGGGGSGGGGSGGGGSGGGGSGGGGSGGGGS

SEQ ID NO: 18 - protein, 43 aa, synthetic construct
  REGION 1..43: note = Linker
GGGGSGSGGSGGGSSGGGGSGGGGSGGGGSGGGGSGGGGSSSS

SEQ ID NO: 19 - protein, 45 aa, synthetic construct
  REGION 1..45: note = Linker
GGGGSGSGGSGGGSSGGGGSGGGGSGGGGSGGGGSGGGGSSSSGS

SEQ ID NO: 20 - protein, 120 aa, synthetic construct
  REGION 1..120: note = CD38 VH
QVQLVQSGAEVVKPGASVKVSCKASGYTFTSYAMHWVKEAPGQGLEWIGYIYPGQGGTNYNQKFQGRATLTADTSASTAYMELSSLRSEDTAVYFCARTGGLRRAYFTYWGQGTLVTVSS

SEQ ID NO: 21 - protein, 121 aa, synthetic construct
  REGION 1..121: note = CD3 VH
QVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSS

SEQ ID NO: 22 - protein, 120 aa, synthetic construct
  REGION 1..120: note = CD28 VH
QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSS

SEQ ID NO: 23 - protein, 124 aa, synthetic construct
  REGION 1..124: note = CD19 VH
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 24 - protein, 122 aa, synthetic construct
  REGION 1..122: note = CD20 VH
EVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSS

SEQ ID NO: 25 - protein, 111 aa, synthetic construct
  REGION 1..111: note = CD38 VL
DIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIK

SEQ ID NO: 26 - protein, 112 aa, synthetic construct
  REGION 1..112: note = CD3 VL
DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIK

SEQ ID NO: 27 - protein, 107 aa, synthetic construct
  REGION 1..107: note = CD28 VL
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIK

SEQ ID NO: 28 - protein, 111 aa, synthetic construct
  REGION 1..111: note = CD19 VL
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 29 - protein, 106 aa, synthetic construct
  REGION 1..106: note = CD20 VL
DIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIK

SEQ ID NO: 30 - protein, 750 aa, synthetic construct
  REGION 1..750: note = peptide
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGSSGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGSSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGGGSGGSGSGGGGSASGSGQVQLVQSGAEVVKPGASVKVSCKASGYTFTSYAMHWVKEAPGQGLEWIGYIYPGQGGTNYNQKFQGRATLTADTSASTAYMELSSLRSEDTAVYFCARTGGLRRAYFTYWGQGTLVTVSSGGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGSSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASGGSGDKTHTCPPCPAPE

SEQ ID NO: 31 - protein, 750 aa, synthetic construct
  REGION 1..750: note = peptide
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGSSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGGGSGGSGSGGGGSASGSGQVQLVQSGAEVVKPGASVKVSCKASGYTFTSYAMHWVKEAPGQGLEWIGYIYPGQGGTNYNQKFQGRATLTADTSASTAYMELSSLRSEDTAVYFCARTGGLRRAYFTYWGQGTLVTVSSGGSSGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGSSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASGGSGDKTHTCPPCPAPE

SEQ ID NO: 32 - protein, 750 aa, synthetic construct
  REGION 1..750: note = peptide
DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGSSGDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGSSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGGGSGGSGSGGGGSASGSGQVQLVQSGAEVVKPGASVKVSCKASGYTFTSYAMHWVKEAPGQGLEWIGYIYPGQGGTNYNQKFQGRATLTADTSASTAYMELSSLRSEDTAVYFCARTGGLRRAYFTYWGQGTLVTVSSGGSSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSGGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASGGSGDKTHTCPPCPAPE

SEQ ID NO: 33 - protein, 750 aa, synthetic construct
  REGION 1..750: note = peptide
DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGSSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGSSGDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGGGSGGSGSGGGGSASGSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSGGSSGQVQLVQSGAEVVKPGASVKVSCKASGYTFTSYAMHWVKEAPGQGLEWIGYIYPGQGGTNYNQKFQGRATLTADTSASTAYMELSSLRSEDTAVYFCARTGGLRRAYFTYWGQGTLVTVSSGGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASGGSGDKTHTCPPCPAPE

SEQ ID NO: 34 - protein, 1229 aa, synthetic construct
  REGION 1..1229: note = peptide
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGSSGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGSSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGGGSGGSGSGGGGSASGSGQVQLVQSGAEVVKPGASVKVSCKASGYTFTSYAMHWVKEAPGQGLEWIGYIYPGQGGTNYNQKFQGRATLTADTSASTAYMELSSLRSEDTAVYFCARTGGLRRAYFTYWGQGTLVTVSSGGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGSSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGSGGSGGGSSGGGGSGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 35 - protein, 1228 aa, synthetic construct
  REGION 1..1228: note = peptide
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGSSGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGSSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGGGSGGSGSGGGGSASGSGQVQLVQSGAEVVKPGASVKVSCKASGYTFTSYAMHWVKEAPGQGLEWIGYIYPGQGGTNYNQKFQGRATLTADTSASTAYMELSSLRSEDTAVYFCARTGGLRRAYFTYWGQGTLVTVSSGGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGSSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGSGGSGGGSSGGGGSGGGGSGGGGSGGGGSGGGGSSSSTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 36 - protein, 1230 aa, synthetic construct
  REGION 1..1230: note = peptide
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGSSGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGSSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGGGSGGSGSGGGGSASGSGQVQLVQSGAEVVKPGASVKVSCKASGYTFTSYAMHWVKEAPGQGLEWIGYIYPGQGGTNYNQKFQGRATLTADTSASTAYMELSSLRSEDTAVYFCARTGGLRRAYFTYWGQGTLVTVSSGGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGSSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGSGGSGGGSSGGGGSGGGGSGGGGSGGGGSGGGGSSSSGSTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 37 - protein, 969 aa, synthetic construct
  REGION 1..969: note = peptide
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGSSGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGSSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGGGSGGSGSGGGGSASGSGQVQLVQSGAEVVKPGASVKVSCKASGYTFTSYAMHWVKEAPGQGLEWIGYIYPGQGGTNYNQKFQGRATLTADTSASTAYMELSSLRSEDTAVYFCARTGGLRRAYFTYWGQGTLVTVSSGGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGSSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASGGSGGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSSGGGGSGGSGSGGSGSGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 38 - protein, 971 aa, synthetic construct
  REGION 1..971: note = peptide
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGSSGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGSSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGGGSGGSGSGGGGSASGSGQVQLVQSGAEVVKPGASVKVSCKASGYTFTSYAMHWVKEAPGQGLEWIGYIYPGQGGTNYNQKFQGRATLTADTSASTAYMELSSLRSEDTAVYFCARTGGLRRAYFTYWGQGTLVTVSSGGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGSSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASGGSGGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGSGSSGGGGSGGSGSGGSGSSGGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 39 - protein, 969 aa, synthetic construct
  REGION 1..969: note = peptide
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGSSGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGSSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGGGSGGSGSGGGGSASGSGQVQLVQSGAEVVKPGASVKVSCKASGYTFTSYAMHWVKEAPGQGLEWIGYIYPGQGGTNYNQKFQGRATLTADTSASTAYMELSSLRSEDTAVYFCARTGGLRRAYFTYWGQGTLVTVSSGGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGSSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASGGSGGQPREPQVCTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSSGGSGSGGSGSGGSGSGQPREPQVYTLPPCRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 40 - protein, 971 aa, synthetic construct
  REGION 1..971: note = peptide
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGSSGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGSSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGGGSGGSGSGGGGSASGSGQVQLVQSGAEVVKPGASVKVSCKASGYTFTSYAMHWVKEAPGQGLEWIGYIYPGQGGTNYNQKFQGRATLTADTSASTAYMELSSLRSEDTAVYFCARTGGLRRAYFTYWGQGTLVTVSSGGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGSSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASGGSGGQPREPQVCTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGSGGSSGGSGSGGSGSGGSGSSGGQPREPQVYTLPPCRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 41 - protein, 1005 aa, synthetic construct
  REGION 1..1005: note = peptide
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGSSGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGSSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGGGSGGSGSGGGGSASGSGQVQLVQSGAEVVKPGASVKVSCKASGYTFTSYAMHWVKEAPGQGLEWIGYIYPGQGGTNYNQKFQGRATLTADTSASTAYMELSSLRSEDTAVYFCARTGGLRRAYFTYWGQGTLVTVSSGGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGSSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASGGSGSSGCPPCPAPEAAGGPSGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGSGSSGGGGSGGSGSGGSGSSGSSGCPPCPAPEAAGGPSGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 42 - protein, 1001 aa, synthetic construct
  REGION 1..1001: note = peptide
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGSSGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGSSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGGGSGGSGSGGGGSASGSGQVQLVQSGAEVVKPGASVKVSCKASGYTFTSYAMHWVKEAPGQGLEWIGYIYPGQGGTNYNQKFQGRATLTADTSASTAYMELSSLRSEDTAVYFCARTGGLRRAYFTYWGQGTLVTVSSGGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGSSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASGGSGSCPPCPAPEAAGGSSGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGSGSSGGGGSGGSGSGGSGSSGSCPPCPAPEAAGGSSGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 43 - protein, 963 aa, synthetic construct
  REGION 1..963: note = peptide
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGSSGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGSSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGGGSGGSGSGGGGSASGSGQVQLVQSGAEVVKPGASVKVSCKASGYTFTSYAMHWVKEAPGQGLEWIGYIYPGQGGTNYNQKFQGRATLTADTSASTAYMELSSLRSEDTAVYFCARTGGLRRAYFTYWGQGTLVTVSSGGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGSSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 44 - protein, 592 aa, synthetic construct
  REGION 1..592: note = peptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGSGSGGGGSASGSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASGGSTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 45 - protein, 725 aa, synthetic construct
  REGION 1..725: note = peptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGSSGDIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKGGGGSGGSGSGGGGSASGSGEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSSGGSSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 46 - protein, 725 aa, synthetic construct
  REGION 1..725: note = peptide
DIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKGGSSGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGSGSGGGGSASGSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGSSGEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 47 - DNA, 2889 bp, synthetic construct
  misc_feature 1..2889: note = full length DNA
  source 1..2889: mol_type = other DNA
gacatccagatgacacagagccctagcagcctgtctgccagcgtgggagacagagtgaccattacctgtcaggccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacattgccacctactactgtcagcagggccagacatacccctacacctttggccagggcaccaagctggaaatcaaaggcggaagcagcggcgacatcgtgatgacccaaacacctctgagcctgagcgtgacacctggacagcctgccagcatcagctgcaagtctagccagagcctggtgcacaacaacgccaacacctacctgtcctggtatctccagaaacctggccagtctcctcagagcctcatctataaggtgtccaacagattcagcggcgtgccagacaggtttagcggctctggatctggcacagatttcacactgaagatcagccgcgtggaagccgaggatgtgggcgtgtactattgcggccagggaacacagtaccctttcacctttggaagcggcacaaaggtcgagatcaaaggtggcagctccggcgatattgtgctgacccagtctccagccacactgtctcttagccctggcgagagagccacaatcagctgtagagccagccagtccgtgtccagctacggccagggtttcatgcattggtatcaacaaaagcctggccagccacctcggctgctgatatatggcgcttccagcagagccacaggcatccctgctagattttccggcagcggctccggcacagactttactctgacaatctccccactggaacccgaggacttcgccgtgtattactgccagcagaacaaagaggacccctggacctttggcggcggaacaaaacttgagatcaaaggcggcggaggaagcggcggatcaggatctggtggcggaggatctgcttctggaagtggacaggtgcagctggtgcagtctggcgccgaagttgtgaaaccaggcgcctctgtgaaggtgtcctgtaaagccagcggctacacattcaccagctacgccatgcactgggtcaaagaggctccaggccaaggactggaatggatcggctacatctatcccggccaaggcggcaccaactacaaccagaagttccagggcagagctaccctgaccgctgatacctctgccagcaccgcctacatggaactgtccagcctgagaagcgaggataccgccgtgtacttctgcgctagaacaggcggactgcggagagcctactttacctattggggacagggcaccctcgtgaccgtttcttctggcggatcttcaggccaggtccagctcgttgaatctggcggaggtgttgtgcagcctggcagaagcctgagactgtcttgtgccgcctccggcttcacctttaccaaggcctggatgcattgggtccgacaggcccctggaaagcagctggaatgggttgcccagatcaaggacaagagcaactcctacgccacctattacgccgacagcgtgaagggcagattcaccatcagccgggacgacagcaagaacaccctgtacctgcagatgaactccctgagagccgaggacacagccgtctattattgccggggagtgtactacgctctgagcccctttgattactggggccaagggacactcgtgacagtgtctagtggcggcagctctggtcaagtccagctggttcaaagcggagccgaggtcgtgaaacctggggccagcgtgaaagtgtcttgcaaggcctctggctataccttcacctcctactacatccactgggttcgacaagccccaggccagggccttgagtggattggcagtatctaccccggcaacgtgaacaccaattacgcccagaaattccaaggacgggccacactgaccgtggacacctctatctccacagcttatatggaactgagccggctgcggagcgacgacaccgctgtgtattattgcaccagaagccactacggcctggattggaacttcgacgtgtggggcaagggcaccacagtgactgtttctagtgcttctggcggatccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 48 - DNA, 2889 bp, synthetic construct
  misc_feature 1..2889: note = full length DNA
  source 1..2889: mol_type = other DNA
gacatccagatgacacagagccctagcagcctgtctgccagcgtgggagacagagtgaccattacctgtcaggccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacattgccacctactactgtcagcagggccagacatacccctacacctttggccagggcaccaagctggaaatcaaaggcggaagctctggccaggtgcagctggttgaatctggtggcggagttgtgcagcctggcagaagcctgagactgtcttgtgccgccagcggcttcacctttaccaaggcctggatgcactgggtccgacaggcacctggaaagcagctggaatgggtcgcccagatcaaggacaagagcaacagctacgccacctattacgccgacagcgtgaagggcagattcaccatcagccgggacgacagcaagaacaccctgtacctgcagatgaacagcctgagagccgaggacaccgccgtgtactactgtagaggcgtgtactatgctctgagccccttcgactattggggccagggaacactcgtgaccgtgtctagcggaggatctagcggcgacatcgtgctgacacagtctcccgctacactgagtctgagccctggcgagagagccacaatcagctgtagagccagccagtccgtgtccagctacggccagggtttcatgcattggtatcaacaaaagcctggccagcctccacggctgctgatatatggcgcttccagcagagccacaggcatccctgctagattttccggcagcggctccggcacagatttcacactgacaatcagccctctggaacccgaggactttgccgtgtattattgccagcagaacaaagaggacccctggacctttggaggcggaacaaagcttgagatcaaaggtggcggcggatctggcggttctggaagcggcggaggtggaagtgcttctggatctggacaggtccagctcgtgcagtctggcgccgaagttgtgaaacctggcgcctctgtgaaggtgtcctgtaaagcctccggctacacattcaccagctatgctatgcattgggtcaaagaggccccaggccagggccttgagtggatcggctatatctatcctggccaaggcggcaccaactacaaccagaagttccagggcagagctaccctgaccgctgatacctctgccagcaccgcctacatggaactgtctagcctgagaagcgaagatacagccgtctacttctgcgccaggacaggcggactgagaagggcctactttacctactggggacagggcaccctggtcacagttagctctggtggatcttccggggacattgtgatgacccagacacctctgagcctgagcgtgacacctggacagcctgccagcatcagctgcaagtctagccagagcctggtgcacaacaacgccaacacctacctgtcttggtatctccagaaacctgggcagagcccacagagcctcatctataaggtgtccaacagattcagcggcgtgccagacaggtttagcggaagcggcagcggaacagactttactctgaagattagccgcgtggaagccgaggatgtgggagtgtattactgcggccaggggacacagtaccctttcacatttggatctggcaccaaggtcgagatcaaaggcggctctagtggacaggtgcaattggtgcagagcggagccgaggttgtcaagccaggggcttccgtgaaagtgtcttgcaaggcaagcggctataccttcacctcctactacatccactgggttcgccaggctccaggccaaggattggaatggatcggcagcatctaccccggcaacgtgaacaccaattacgcccagaaattccaaggacgggccacactgaccgtggacacctctatctccacagcttatatggaactgagccggctgcggagcgacgataccgccgtttattactgcaccagaagccactacggcctggactggaatttcgacgtgtggggcaagggcaccacagtgacagtgtcctctgctagtggtggctccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 49 - DNA, 2889 bp, synthetic construct
  misc_feature 1..2889: note = full length DNA
  source 1..2889: mol_type = other DNA
gacatcgtgatgacccagacacctctgagcctgagcgtgacacctggacagcctgccagcatcagctgcaagtctagccagagcctggtgcacaacaacgccaacacctacctgagctggtatctgcagaagcccggccagtctcctcagagcctgatctacaaggtgtccaacagattcagcggcgtgcccgacagattttctggcagcggctctggcaccgacttcaccctgaagatcagcagagtggaagccgaggacgtgggcgtgtactattgtggccagggcacacagtaccccttcacatttggaagcggcaccaaggtggaaatcaaaggcggcagctctggcgacatccagatgacacagagccctagcagcctgtctgccagcgtgggagacagagtgaccattacctgtcaggccagccagaacatctacgtgtggctgaattggtatcagcaaaagcctggcaaggcccctaagctgctcatctataaggccagcaacctgcacaccggcgtgccaagcagattctctggatctggctccggcacagatttcacactgaccataagcagcctgcagcctgaggacattgccacctactactgtcagcagggccagacatacccctacaccttcggccagggaacaaagcttgagatcaaaggtggaagcagcggcgacattgtgctgacacagtctcccgccacactgtctcttagccctggcgagagagccacaatcagctgtagagccagccagtccgtgtccagctacggccagggtttcatgcactggtatcaacagaaacccggacagccacctcggctgctgatatacggtgcctctagcagagccacaggcatccctgctagattttccggctctggaagcggaaccgactttacgctgacaatcagccctctggaacccgaggatttcgccgtgtattactgccagcagaacaaagaggacccctggacctttggcggaggcacaaaattggagatcaaaggcggaggcggcagcggcggaagtggatctggtggcggaggatctgcttctggctctggacaggttcagctggtgcagtctggcgccgaggttgtgaaacctggcgcctccgtgaaggtgtcctgtaaagccagcggctacacctttaccagctacgccatgcattgggtcaaagaggccccaggccaaggcctggaatggatcggctatatctaccctggccaaggcggcacaaactacaaccagaagttccagggcagagctaccctgaccgctgatacaagcgccagcaccgcctacatggaactgtccagtctgagaagcgaggatacagccgtgtacttctgcgccagaacaggcggactgcggagagcctactttacctattggggacagggaaccctcgtgaccgtgtctagtggcggatctagtggccaggtgcagctcgttcaaagcggagccgaagtggttaagccaggcgccagcgtgaaagtgtcttgcaaggcctccggctataccttcacctcctactacatccactgggtccgacaggcccctggacagggacttgagtggatcggcagcatctaccccggcaacgtgaacaccaactacgcccagaaattccaaggacgggccactctgaccgtggacacctctatctccacagcttatatggaactgagccggctgcggagcgacgacaccgctgtgtactactgtaccagaagccactacggcctggactggaatttcgacgtgtggggcaagggcaccaccgtgacagtttcttccggcggatcttccgggcaagtgcagcttgttgaaagtggcggcggagttgtgcagcctggcagaagtctgagactgtcttgtgccgcatccggcttcacattcaccaaagcctggatgcactgggttcgccaggctccaggcaaacagctggaatgggttgcccagatcaaggacaagagcaactcctacgccacctattacgccgacagcgtgaagggcagattcaccatcagccgggacgacagcaagaacaccctgtacctgcagatgaacagcctgcgcgccgaagataccgccgtctactattgccggggagtgtactacgctctgagcccctttgattactggggccaaggcaccctggtcacagtgtctagcgcatctggtggatccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 50 - DNA, 2889 bp, synthetic construct
  misc_feature 1..2889: note = full length DNA
  source 1..2889: mol_type = other DNA
gacatcgtgatgacccagacacctctgagcctgagcgtgacacctggacagcctgccagcatcagctgcaagtctagccagagcctggtgcacaacaacgccaacacctacctgagctggtatctgcagaagcccggccagtctcctcagagcctgatctacaaggtgtccaacagattcagcggcgtgcccgacagattttctggcagcggctctggcaccgacttcaccctgaagatcagcagagtggaagccgaggacgtgggcgtgtactattgtggccagggcacacagtaccccttcacatttggaagcggcaccaaggtggaaatcaaaggcggcagctctggcgacattgtgctgacacagtctcccgccacactgtctcttagccctggcgagagagccacaatcagctgtagagccagccagagcgtgtccagctacggccagggtttcatgcactggtatcagcaaaaacctggccagccacctcggctgctgatatacggtgcttccagcagagccacaggcatccctgccagattttccggctctggaagcggaaccgatttcacactgacaatcagccctctggaacccgaggatttcgccgtgtactactgccagcagaacaaagaggacccctggacctttggcggaggcacaaagcttgagatcaaaggtggaagcagcggcgacatccagatgacacagagcccttctagcctgtctgccagcgtgggcgacagagtgacaattacctgtcaggcctctcagaacatctacgtgtggctgaattggtatcaacagaagcctggcaaggccccaaagctgctcatctataaggccagcaacctgcacaccggcgtgccaagcagattctctggttctggctccggcacagactttacactgaccataagcagcctgcagcctgaggacattgccacctactattgtcagcagggccagacatacccctacaccttcggccagggaacaaaattggagatcaaaggcggaggcggcagcggcggatctggatctggtggcggaggatctgcaagtggctctggacaggttcagctggtgcagtctggcgccgaggttgtgaaacctggcgcctccgtgaaggtgtcctgtaaagccagcggctacacctttaccagctactacatccactgggtccgacaggcccctggacaaggacttgagtggatcggcagcatctaccccggcaacgtgaacaccaactacgcccagaagttccagggcagagctaccctgacagtggacaccagcatctccaccgcctacatggaactgagccggctgagatccgatgacaccgccgtgtattattgcaccagaagccactacggcctggactggaatttcgacgtgtggggcaagggcaccaccgtgacagttagttctggcggatctagcggccaggtgcagcttgttcaaagcggagccgaagtggttaagccaggcgccagcgtgaaagtgtcttgcaaggcctccggctataccttcacctcctacgccatgcattgggtcaaagaggccccaggccagggccttgaatggattggctacatctatcctggccaaggcggcacaaactacaaccagaaatttcaggggcgagccacactgaccgccgatacaagtgccagcacagcatatatggaactgtccagcctgcggagcgaggataccgctgtgtacttctgtgccagaacaggcggactgcggagagcctactttacctattggggacagggaaccctcgtgaccgtgtctagtggtggaagctcaggacaggtgcaactcgtggaaagtggcggcggagttgtgcagcctggaagaagcctgagactgtcttgtgccgcatccggcttcacattcaccaaggcctggatgcactgggttcgccaggctccaggcaaacagctggaatgggttgcccagatcaaggacaagagcaacagctacgccacctattacgccgacagcgtgaagggcagattcaccatcagccgggacgacagcaagaacaccctgtacctgcagatgaacagcctgcgcgccgaagataccgccgtctattactgtcggggagtgtactacgctctgagccccttcgattactggggccaaggcacactggtcacagtgtctagcgcatctggtggatccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 51 - DNA, 3687 bp, synthetic construct
  misc_feature 1..3687: note = full length DNA
  source 1..3687: mol_type = other DNA
gacatccagatgacacagagccctagcagcctgtctgccagcgtgggagacagagtgaccattacctgtcaggccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacattgccacctactactgtcagcagggccagacatacccctacacctttggccagggcaccaagctggaaatcaaaggcggaagcagcggcgacatcgtgatgacccaaacacctctgagcctgagcgtgacacctggacagcctgccagcatcagctgcaagtctagccagagcctggtgcacaacaacgccaacacctacctgtcctggtatctccagaaacctggccagtctcctcagagcctcatctataaggtgtccaacagattcagcggcgtgccagacaggtttagcggctctggatctggcacagatttcacactgaagatcagccgcgtggaagccgaggatgtgggcgtgtactattgcggccagggaacacagtaccctttcacctttggaagcggcacaaaggtcgagatcaaaggtggcagctccggcgatattgtgctgacccagtctccagccacactgtctcttagccctggcgagagagccacaatcagctgtagagccagccagtccgtgtccagctacggccagggtttcatgcattggtatcaacaaaagcctggccagccacctcggctgctgatatatggcgcttccagcagagccacaggcatccctgctagattttccggcagcggctccggcacagactttactctgacaatctccccactggaacccgaggacttcgccgtgtattactgccagcagaacaaagaggacccctggacctttggcggcggaacaaaacttgagatcaaaggcggcggaggaagcggcggatcaggatctggtggcggaggatctgcttctggaagtggacaggtgcagctggtgcagtctggcgccgaagttgtgaaaccaggcgcctctgtgaaggtgtcctgtaaagccagcggctacacattcaccagctacgccatgcactgggtcaaagaggctccaggccaaggactggaatggatcggctacatctatcccggccaaggcggcaccaactacaaccagaagttccagggcagagctaccctgaccgctgatacctctgccagcaccgcctacatggaactgtccagcctgagaagcgaggataccgccgtgtacttctgcgctagaacaggcggactgcggagagcctactttacctattggggacagggcaccctcgtgaccgtttcttctggcggatcttcaggccaggtccagctcgttgaatctggcggaggtgttgtgcagcctggcagaagcctgagactgtcttgtgccgcctccggcttcacctttaccaaggcctggatgcattgggtccgacaggcccctggaaagcagctggaatgggttgcccagatcaaggacaagagcaactcctacgccacctattacgccgacagcgtgaagggcagattcaccatcagccgggacgacagcaagaacaccctgtacctgcagatgaactccctgagagccgaggacacagccgtctattattgccggggagtgtactacgctctgagcccctttgattactggggccaagggacactcgtgacagtgtctagtggcggcagctctggtcaagtccagctggttcaaagcggagccgaggtcgtgaaacctggggccagcgtgaaagtgtcttgcaaggcctctggctataccttcacctcctactacatccactgggttcgacaagccccaggccagggccttgagtggattggcagtatctaccccggcaacgtgaacaccaattacgcccagaaattccaaggacgggccacactgaccgtggacacctctatctccacagcttatatggaactgagccggctgcggagcgacgacaccgctgtgtattattgcaccagaagccactacggcctggattggaacttcgacgtgtggggcaagggcaccacagtgactgtttctagtgcctctggcggatccggagacaagacccacacctgtcctccatgtcctgctccagaagctgctggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggagcctcaggtgtacacactgcctccaagcagagatgagctgaccaagaaccaggtgtccctgacctgtctggtcaagggcttctacccctccgatatcgccgtggaatgggagagcaatggccagcctgagaacaactacaagaccacacctcctgtgctggacagcgacggctcattcttcctgtacagcaagctgaccgtggacaagagcagatggcagcagggcaacgtgttcagctgcagcgtgatgcacgaggccctgcacaaccactacacccagaagtccctgtctctgtctcctggcggaggcggaggatctggtagcggtggatctggcggcggatcttcaggtggcggaggaagtggcggcggaggtagcggaggtggtggaagcggaggtggcggatcaggcggcggaggctctgataagacacacacctgtcctccatgtcctgctccagaagctgctggcggcccttccgtgtttctgttccctccaaagcctaaggacaccctgatgatcagccgtacgcctgaagtgacctgcgtggtggtggatgtgtctcacgaagatcccgaagtgaagtttaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctggccgctcctatcgagaaaaccatcagcaaggccaagggccagccaagagaaccccaggtttacaccctgccaccttctagggacgaactcaccaagaatcaagtgtctctcacatgcctcgtgaaggggttttaccccagcgacattgccgtcgagtgggagtccaatggacaacccgagaacaattataagacgaccccaccagtcctggactccgacggctcattctttctctactctaaactcaccgtggataagtcccggtggcagcaagggaatgtgttttcctgctccgtgatgcatgaagctctccacaatcattacacccaaaagagtctgtctctgagccccggc

SEQ ID NO: 52 - DNA, 3684 bp, synthetic construct
  misc_feature 1..3684: note = full length DNA
  source 1..3684: mol_type = other DNA
gacatccagatgacacagagccctagcagcctgtctgccagcgtgggagacagagtgaccattacctgtcaggccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacattgccacctactactgtcagcagggccagacatacccctacacctttggccagggcaccaagctggaaatcaaaggcggaagcagcggcgacatcgtgatgacccaaacacctctgagcctgagcgtgacacctggacagcctgccagcatcagctgcaagtctagccagagcctggtgcacaacaacgccaacacctacctgtcctggtatctccagaaacctggccagtctcctcagagcctcatctataaggtgtccaacagattcagcggcgtgccagacaggtttagcggctctggatctggcacagatttcacactgaagatcagccgcgtggaagccgaggatgtgggcgtgtactattgcggccagggaacacagtaccctttcacctttggaagcggcacaaaggtcgagatcaaaggtggcagctccggcgatattgtgctgacccagtctccagccacactgtctcttagccctggcgagagagccacaatcagctgtagagccagccagtccgtgtccagctacggccagggtttcatgcattggtatcaacaaaagcctggccagccacctcggctgctgatatatggcgcttccagcagagccacaggcatccctgctagattttccggcagcggctccggcacagactttactctgacaatctccccactggaacccgaggacttcgccgtgtattactgccagcagaacaaagaggacccctggacctttggcggcggaacaaaacttgagatcaaaggcggcggaggaagcggcggatcaggatctggtggcggaggatctgcttctggaagtggacaggtgcagctggtgcagtctggcgccgaagttgtgaaaccaggcgcctctgtgaaggtgtcctgtaaagccagcggctacacattcaccagctacgccatgcactgggtcaaagaggctccaggccaaggactggaatggatcggctacatctatcccggccaaggcggcaccaactacaaccagaagttccagggcagagctaccctgaccgctgatacctctgccagcaccgcctacatggaactgtccagcctgagaagcgaggataccgccgtgtacttctgcgctagaacaggcggactgcggagagcctactttacctattggggacagggcaccctcgtgaccgtttcttctggcggatcttcaggccaggtccagctcgttgaatctggcggaggtgttgtgcagcctggcagaagcctgagactgtcttgtgccgcctccggcttcacctttaccaaggcctggatgcattgggtccgacaggcccctggaaagcagctggaatgggttgcccagatcaaggacaagagcaactcctacgccacctattacgccgacagcgtgaagggcagattcaccatcagccgggacgacagcaagaacaccctgtacctgcagatgaactccctgagagccgaggacacagccgtctattattgccggggagtgtactacgctctgagcccctttgattactggggccaagggacactcgtgacagtgtctagtggcggcagctctggtcaagtccagctggttcaaagcggagccgaggtcgtgaaacctggggccagcgtgaaagtgtcttgcaaggcctctggctataccttcacctcctactacatccactgggttcgacaagccccaggccagggccttgagtggattggcagtatctaccccggcaacgtgaacaccaattacgcccagaaattccaaggacgggccacactgaccgtggacacctctatctccacagcttatatggaactgagccggctgcggagcgacgacaccgctgtgtattattgcaccagaagccactacggcctggattggaacttcgacgtgtggggcaagggcaccacagtgactgtttctagtgcctctggcggatccggagacaagacccacacctgtcctccatgtcctgctccagaagctgctggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggagcctcaggtgtacacactgcctccaagcagagatgagctgaccaagaaccaggtgtccctgacctgtctggtcaagggcttctacccctccgatatcgccgtggaatgggagagcaatggccagcctgagaacaactacaagaccacacctcctgtgctggacagcgacggctcattcttcctgtacagcaagctgaccgtggacaagagcagatggcagcagggcaacgtgttcagctgcagcgtgatgcacgaggccctgcacaaccactacacccagaagtccctgtctctgtctcctggcggaggcggaggatctggtagcggtggatctggcggcggatcttcaggtggcggaggaagtggcggcggaggtagcggaggtggtggaagcggaggtggcggatcaggcggcggaggctctagctctagtacctgtcctccatgtcctgctccagaagctgctggcggcccttccgtgtttctgttccctccaaagcctaaggacaccctgatgatcagccgtacgcctgaagtgacctgcgtggtggtggatgtgtctcacgaagatcccgaagtgaagtttaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctggccgctcctatcgagaaaaccatcagcaaggccaagggccagccaagagaaccccaggtttacaccctgccaccttctagggacgaactcaccaagaatcaagtgtctctcacatgcctcgtgaaggggttttaccccagcgacattgccgtcgagtgggagtccaatggacaacccgagaacaattataagacgaccccaccagtcctggactccgacggctcattctttctctactctaaactcaccgtggataagtcccggtggcagcaagggaatgtgttttcctgctccgtgatgcatgaagctctccacaatcattacacccaaaagagtctgtctctgagccccggc

SEQ ID NO: 53 - DNA, 3690 bp, synthetic construct
  misc_feature 1..3690: note = full length DNA
  source 1..3690: mol_type = other DNA
gacatccagatgacacagagccctagcagcctgtctgccagcgtgggagacagagtgaccattacctgtcaggccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacattgccacctactactgtcagcagggccagacatacccctacacctttggccagggcaccaagctggaaatcaaaggcggaagcagcggcgacatcgtgatgacccaaacacctctgagcctgagcgtgacacctggacagcctgccagcatcagctgcaagtctagccagagcctggtgcacaacaacgccaacacctacctgtcctggtatctccagaaacctggccagtctcctcagagcctcatctataaggtgtccaacagattcagcggcgtgccagacaggtttagcggctctggatctggcacagatttcacactgaagatcagccgcgtggaagccgaggatgtgggcgtgtactattgcggccagggaacacagtaccctttcacctttggaagcggcacaaaggtcgagatcaaaggtggcagctccggcgatattgtgctgacccagtctccagccacactgtctcttagccctggcgagagagccacaatcagctgtagagccagccagtccgtgtccagctacggccagggtttcatgcattggtatcaacaaaagcctggccagccacctcggctgctgatatatggcgcttccagcagagccacaggcatccctgctagattttccggcagcggctccggcacagactttactctgacaatctccccactggaacccgaggacttcgccgtgtattactgccagcagaacaaagaggacccctggacctttggcggcggaacaaaacttgagatcaaaggcggcggaggaagcggcggatcaggatctggtggcggaggatctgcttctggaagtggacaggtgcagctggtgcagtctggcgccgaagttgtgaaaccaggcgcctctgtgaaggtgtcctgtaaagccagcggctacacattcaccagctacgccatgcactgggtcaaagaggctccaggccaaggactggaatggatcggctacatctatcccggccaaggcggcaccaactacaaccagaagttccagggcagagctaccctgaccgctgatacctctgccagcaccgcctacatggaactgtccagcctgagaagcgaggataccgccgtgtacttctgcgctagaacaggcggactgcggagagcctactttacctattggggacagggcaccctcgtgaccgtttcttctggcggatcttcaggccaggtccagctcgttgaatctggcggaggtgttgtgcagcctggcagaagcctgagactgtcttgtgccgcctccggcttcacctttaccaaggcctggatgcattgggtccgacaggcccctggaaagcagctggaatgggttgcccagatcaaggacaagagcaactcctacgccacctattacgccgacagcgtgaagggcagattcaccatcagccgggacgacagcaagaacaccctgtacctgcagatgaactccctgagagccgaggacacagccgtctattattgccggggagtgtactacgctctgagcccctttgattactggggccaagggacactcgtgacagtgtctagtggcggcagctctggtcaagtccagctggttcaaagcggagccgaggtcgtgaaacctggggccagcgtgaaagtgtcttgcaaggcctctggctataccttcacctcctactacatccactgggttcgacaagccccaggccagggccttgagtggattggcagtatctaccccggcaacgtgaacaccaattacgcccagaaattccaaggacgggccacactgaccgtggacacctctatctccacagcttatatggaactgagccggctgcggagcgacgacaccgctgtgtattattgcaccagaagccactacggcctggattggaacttcgacgtgtggggcaagggcaccacagtgactgtttctagtgcctctggcggatccggagacaagacccacacctgtcctccatgtcctgctccagaagctgctggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggagcctcaggtgtacacactgcctccaagcagagatgagctgaccaagaaccaggtgtccctgacctgtctggtcaagggcttctacccctccgatatcgccgtggaatgggagagcaatggccagcctgagaacaactacaagaccacacctcctgtgctggacagcgacggctcattcttcctgtacagcaagctgaccgtggacaagagcagatggcagcagggcaacgtgttcagctgcagcgtgatgcacgaggccctgcacaaccactacacccagaagtccctgtctctgtctcctggcggaggcggaggatctggtagcggtggatctggcggcggatcttcaggtggcggaggaagtggcggcggaggtagcggaggtggtggaagcggaggtggcggatcaggcggcggaggctctagctctagtggctctacctgtcctccatgtcctgctccagaagctgctggcggcccttccgtgtttctgttccctccaaagcctaaggacaccctgatgatcagccgtacgcctgaagtgacctgcgtggtggtggatgtgtctcacgaagatcccgaagtgaagtttaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctggccgctcctatcgagaaaaccatcagcaaggccaagggccagccaagagaaccccaggtttacaccctgccaccttctagggacgaactcaccaagaatcaagtgtctctcacatgcctcgtgaaggggttttaccccagcgacattgccgtcgagtgggagtccaatggacaacccgagaacaattataagacgaccccaccagtcctggactccgacggctcattctttctctactctaaactcaccgtggataagtcccggtggcagcaagggaatgtgttttcctgctccgtgatgcatgaagctctccacaatcattacacccaaaagagtctgtctctgagccccggc

SEQ ID NO: 54 - DNA, 2907 bp, synthetic construct
  misc_feature 1..2907: note = full length DNA
  source 1..2907: mol_type = other DNA
gacatccagatgacacagagccctagcagcctgtctgccagcgtgggagacagagtgaccattacctgtcaggccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacattgccacctactactgtcagcagggccagacatacccctacacctttggccagggcaccaagctggaaatcaaaggcggaagcagcggcgacatcgtgatgacccaaacacctctgagcctgagcgtgacacctggacagcctgccagcatcagctgcaagtctagccagagcctggtgcacaacaacgccaacacctacctgtcctggtatctccagaaacctggccagtctcctcagagcctcatctataaggtgtccaacagattcagcggcgtgccagacaggtttagcggctctggatctggcacagatttcacactgaagatcagccgcgtggaagccgaggatgtgggcgtgtactattgcggccagggaacacagtaccctttcacctttggaagcggcacaaaggtcgagatcaaaggtggcagctccggcgatattgtgctgacccagtctccagccacactgtctcttagccctggcgagagagccacaatcagctgtagagccagccagtccgtgtccagctacggccagggtttcatgcattggtatcaacaaaagcctggccagccacctcggctgctgatatatggcgcttccagcagagccacaggcatccctgctagattttccggcagcggctccggcacagactttactctgacaatctccccactggaacccgaggacttcgccgtgtattactgccagcagaacaaagaggacccctggacctttggcggcggaacaaaacttgagatcaaaggcggcggaggaagcggcggatcaggatctggtggcggaggatctgcttctggaagtggacaggtgcagctggtgcagtctggcgccgaagttgtgaaaccaggcgcctctgtgaaggtgtcctgtaaagccagcggctacacattcaccagctacgccatgcactgggtcaaagaggctccaggccaaggactggaatggatcggctacatctatcccggccaaggcggcaccaactacaaccagaagttccagggcagagctaccctgaccgctgatacctctgccagcaccgcctacatggaactgtccagcctgagaagcgaggataccgccgtgtacttctgcgctagaacaggcggactgcggagagcctactttacctattggggacagggcaccctcgtgaccgtttcttctggcggatcttcaggccaggtccagctcgttgaatctggcggaggtgttgtgcagcctggcagaagcctgagactgtcttgtgccgcctccggcttcacctttaccaaggcctggatgcattgggtccgacaggcccctggaaagcagctggaatgggttgcccagatcaaggacaagagcaactcctacgccacctattacgccgacagcgtgaagggcagattcaccatcagccgggacgacagcaagaacaccctgtacctgcagatgaactccctgagagccgaggacacagccgtctattattgccggggagtgtactacgctctgagcccctttgattactggggccaagggacactcgtgacagtgtctagtggcggcagctctggtcaagtccagctggttcaaagcggagccgaggtcgtgaaacctggggccagcgtgaaagtgtcttgcaaggcctctggctataccttcacctcctactacatccactgggttcgacaagccccaggccagggccttgagtggattggcagtatctaccccggcaacgtgaacaccaattacgcccagaaattccaaggacgggccacactgaccgtggacacctctatctccacagcttatatggaactgagccggctgcggagcgacgacaccgctgtgtattattgcaccagaagccactacggcctggattggaacttcgacgtgtggggcaagggcaccacagtgactgtttctagtgcctctggcggatccggaggccagcctagggaaccccaggtttacacactgcctccaagcagggacgagctgaccaagaatcaggtgtccctgacctgcctcgtgaagggcttttaccccagcgacattgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctggaggcggaggatcttctggcggaggtggaagtggtggatctggctctggcggttctggatctggacagccgcgggaaccccaggtctacaccttgccaccatccagggacgaactgacaaagaatcaagtctctctgacctgcctcgtgaaggggttttaccctagcgacattgccgtcgagtgggagtctaacgggcagcccgaaaacaattataagacaaccccaccagtgctggactccgatggctcattctttctctactctaaactcaccgtggataagtcccggtggcagcaagggaatgtgttttcctgctccgtgatgcatgaagctctccacaatcattacacccaaaagagtctgtctctgagccccggc

SEQ ID NO: 55 - DNA, 2913 bp, synthetic construct
  misc_feature 1..2913: note = full length DNA
  source 1..2913: mol_type = other DNA
gacatccagatgacacagagccctagcagcctgtctgccagcgtgggagacagagtgaccattacctgtcaggccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacattgccacctactactgtcagcagggccagacatacccctacacctttggccagggcaccaagctggaaatcaaaggcggaagcagcggcgacatcgtgatgacccaaacacctctgagcctgagcgtgacacctggacagcctgccagcatcagctgcaagtctagccagagcctggtgcacaacaacgccaacacctacctgtcctggtatctccagaaacctggccagtctcctcagagcctcatctataaggtgtccaacagattcagcggcgtgccagacaggtttagcggctctggatctggcacagatttcacactgaagatcagccgcgtggaagccgaggatgtgggcgtgtactattgcggccagggaacacagtaccctttcacctttggaagcggcacaaaggtcgagatcaaaggtggcagctccggcgatattgtgctgacccagtctccagccacactgtctcttagccctggcgagagagccacaatcagctgtagagccagccagtccgtgtccagctacggccagggtttcatgcattggtatcaacaaaagcctggccagccacctcggctgctgatatatggcgcttccagcagagccacaggcatccctgctagattttccggcagcggctccggcacagactttactctgacaatctccccactggaacccgaggacttcgccgtgtattactgccagcagaacaaagaggacccctggacctttggcggcggaacaaaacttgagatcaaaggcggcggaggaagcggcggatcaggatctggtggcggaggatctgcttctggaagtggacaggtgcagctggtgcagtctggcgccgaagttgtgaaaccaggcgcctctgtgaaggtgtcctgtaaagccagcggctacacattcaccagctacgccatgcactgggtcaaagaggctccaggccaaggactggaatggatcggctacatctatcccggccaaggcggcaccaactacaaccagaagttccagggcagagctaccctgaccgctgatacctctgccagcaccgcctacatggaactgtccagcctgagaagcgaggataccgccgtgtacttctgcgctagaacaggcggactgcggagagcctactttacctattggggacagggcaccctcgtgaccgtttcttctggcggatcttcaggccaggtccagctcgttgaatctggcggaggtgttgtgcagcctggcagaagcctgagactgtcttgtgccgcctccggcttcacctttaccaaggcctggatgcattgggtccgacaggcccctggaaagcagctggaatgggttgcccagatcaaggacaagagcaactcctacgccacctattacgccgacagcgtgaagggcagattcaccatcagccgggacgacagcaagaacaccctgtacctgcagatgaactccctgagagccgaggacacagccgtctattattgccggggagtgtactacgctctgagcccctttgattactggggccaagggacactcgtgacagtgtctagtggcggcagctctggtcaagtccagctggttcaaagcggagccgaggtcgtgaaacctggggccagcgtgaaagtgtcttgcaaggcctctggctataccttcacctcctactacatccactgggttcgacaagccccaggccagggccttgagtggattggcagtatctaccccggcaacgtgaacaccaattacgcccagaaattccaaggacgggccacactgaccgtggacacctctatctccacagcttatatggaactgagccggctgcggagcgacgacaccgctgtgtattattgcaccagaagccactacggcctggattggaacttcgacgtgtggggcaagggcaccacagtgactgtttctagtgcctctggcggatccggaggccagcctagggaaccccaggtttacacactgcctccaagcagggacgagctgaccaagaatcaggtgtccctgacctgcctcgtgaagggcttttaccccagcgacattgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctggaggcagcggatcttctggcggaggtggaagtggtggatctggctctggcggttctggatctagcggtggacagccgcgggaaccccaggtctacaccttgccaccatccagggacgaactgacaaagaatcaagtctctctgacctgcctcgtgaaggggttttaccctagcgacattgccgtcgagtgggagtctaacgggcagcccgaaaacaattataagacaaccccaccagtgctggactccgatggctcattctttctctactctaaactcaccgtggataagtcccggtggcagcaagggaatgtgttttcctgctccgtgatgcatgaagctctccacaatcattacacccaaaagagtctgtctctgagccccggc

SEQ ID NO: 56 - DNA, 2907 bp, synthetic construct
  misc_feature 1..2907: note = full length DNA
  source 1..2907: mol_type = other DNA
gacatccagatgacacagagccctagcagcctgtctgccagcgtgggagacagagtgaccattacctgtcaggccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacattgccacctactactgtcagcagggccagacatacccctacacctttggccagggcaccaagctggaaatcaaaggcggaagcagcggcgacatcgtgatgacccaaacacctctgagcctgagcgtgacacctggacagcctgccagcatcagctgcaagtctagccagagcctggtgcacaacaacgccaacacctacctgtcctggtatctccagaaacctggccagtctcctcagagcctcatctataaggtgtccaacagattcagcggcgtgccagacaggtttagcggctctggatctggcacagatttcacactgaagatcagccgcgtggaagccgaggatgtgggcgtgtactattgcggccagggaacacagtaccctttcacctttggaagcggcacaaaggtcgagatcaaaggtggcagctccggcgatattgtgctgacccagtctccagccacactgtctcttagccctggcgagagagccacaatcagctgtagagccagccagtccgtgtccagctacggccagggtttcatgcattggtatcaacaaaagcctggccagccacctcggctgctgatatatggcgcttccagcagagccacaggcatccctgctagattttccggcagcggctccggcacagactttactctgacaatctccccactggaacccgaggacttcgccgtgtattactgccagcagaacaaagaggacccctggacctttggcggcggaacaaaacttgagatcaaaggcggcggaggaagcggcggatcaggatctggtggcggaggatctgcttctggaagtggacaggtgcagctggtgcagtctggcgccgaagttgtgaaaccaggcgcctctgtgaaggtgtcctgtaaagccagcggctacacattcaccagctacgccatgcactgggtcaaagaggctccaggccaaggactggaatggatcggctacatctatcccggccaaggcggcaccaactacaaccagaagttccagggcagagctaccctgaccgctgatacctctgccagcaccgcctacatggaactgtccagcctgagaagcgaggataccgccgtgtacttctgcgctagaacaggcggactgcggagagcctactttacctattggggacagggcaccctcgtgaccgtttcttctggcggatcttcaggccaggtccagctcgttgaatctggcggaggtgttgtgcagcctggcagaagcctgagactgtcttgtgccgcctccggcttcacctttaccaaggcctggatgcattgggtccgacaggcccctggaaagcagctggaatgggttgcccagatcaaggacaagagcaactcctacgccacctattacgccgacagcgtgaagggcagattcaccatcagccgggacgacagcaagaacaccctgtacctgcagatgaactccctgagagccgaggacacagccgtctattattgccggggagtgtactacgctctgagcccctttgattactggggccaagggacactcgtgacagtgtctagtggcggcagctctggtcaagtccagctggttcaaagcggagccgaggtcgtgaaacctggggccagcgtgaaagtgtcttgcaaggcctctggctataccttcacctcctactacatccactgggttcgacaagccccaggccagggccttgagtggattggcagtatctaccccggcaacgtgaacaccaattacgcccagaaattccaaggacgggccacactgaccgtggacacctctatctccacagcttatatggaactgagccggctgcggagcgacgacaccgctgtgtattattgcaccagaagccactacggcctggattggaacttcgacgtgtggggcaagggcaccacagtgactgtttctagtgcctctggcggatccggaggccagcctagggaaccccaggtttgcacactgcctccaagcagggacgagctgaccaagaatcaggtgtccctgacctgcctcgtgaagggcttttaccccagcgacattgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctggaggcggaggatcttctggcggaagtggaagtggtggatctggctctggcggttctggatctggacagccgcgggaaccccaggtctacaccttgccaccatgcagggacgaactgacaaagaatcaagtctctctgacctgcctcgtgaaggggttttaccctagcgacattgccgtcgagtgggagtctaacgggcagcccgaaaacaattataagacaaccccaccagtgctggactccgatggctcattctttctctactctaaactcaccgtggataagtcccggtggcagcaagggaatgtgttttcctgctccgtgatgcatgaagctctccacaatcattacacccaaaagagtctgtctctgagccccggc

SEQ ID NO: 57 - DNA, 2913 bp, synthetic construct
  misc_feature 1..2913: note = full length DNA
  source 1..2913: mol_type = other DNA
gacatccagatgacacagagccctagcagcctgtctgccagcgtgggagacagagtgaccattacctgtcaggccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacattgccacctactactgtcagcagggccagacatacccctacacctttggccagggcaccaagctggaaatcaaaggcggaagcagcggcgacatcgtgatgacccaaacacctctgagcctgagcgtgacacctggacagcctgccagcatcagctgcaagtctagccagagcctggtgcacaacaacgccaacacctacctgtcctggtatctccagaaacctggccagtctcctcagagcctcatctataaggtgtccaacagattcagcggcgtgccagacaggtttagcggctctggatctggcacagatttcacactgaagatcagccgcgtggaagccgaggatgtgggcgtgtactattgcggccagggaacacagtaccctttcacctttggaagcggcacaaaggtcgagatcaaaggtggcagctccggcgatattgtgctgacccagtctccagccacactgtctcttagccctggcgagagagccacaatcagctgtagagccagccagtccgtgtccagctacggccagggtttcatgcattggtatcaacaaaagcctggccagccacctcggctgctgatatatggcgcttccagcagagccacaggcatccctgctagattttccggcagcggctccggcacagactttactctgacaatctccccactggaacccgaggacttcgccgtgtattactgccagcagaacaaagaggacccctggacctttggcggcggaacaaaacttgagatcaaaggcggcggaggaagcggcggatcaggatctggtggcggaggatctgcttctggaagtggacaggtgcagctggtgcagtctggcgccgaagttgtgaaaccaggcgcctctgtgaaggtgtcctgtaaagccagcggctacacattcaccagctacgccatgcactgggtcaaagaggctccaggccaaggactggaatggatcggctacatctatcccggccaaggcggcaccaactacaaccagaagttccagggcagagctaccctgaccgctgatacctctgccagcaccgcctacatggaactgtccagcctgagaagcgaggataccgccgtgtacttctgcgctagaacaggcggactgcggagagcctactttacctattggggacagggcaccctcgtgaccgtttcttctggcggatcttcaggccaggtccagctcgttgaatctggcggaggtgttgtgcagcctggcagaagcctgagactgtcttgtgccgcctccggcttcacctttaccaaggcctggatgcattgggtccgacaggcccctggaaagcagctggaatgggttgcccagatcaaggacaagagcaactcctacgccacctattacgccgacagcgtgaagggcagattcaccatcagccgggacgacagcaagaacaccctgtacctgcagatgaactccctgagagccgaggacacagccgtctattattgccggggagtgtactacgctctgagcccctttgattactggggccaagggacactcgtgacagtgtctagtggcggcagctctggtcaagtccagctggttcaaagcggagccgaggtcgtgaaacctggggccagcgtgaaagtgtcttgcaaggcctctggctataccttcacctcctactacatccactgggttcgacaagccccaggccagggccttgagtggattggcagtatctaccccggcaacgtgaacaccaattacgcccagaaattccaaggacgggccacactgaccgtggacacctctatctccacagcttatatggaactgagccggctgcggagcgacgacaccgctgtgtattattgcaccagaagccactacggcctggattggaacttcgacgtgtggggcaagggcaccacagtgactgtttctagtgcctctggcggatccggaggccagcctagggaaccccaggtttgcacactgcctccaagcagggacgagctgaccaagaatcaggtgtccctgacctgcctcgtgaagggcttttaccccagcgacattgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctggaagcggaggatcttctggcggaagtggaagtggtggatctggctctggcggttctggatctagcggtggacagccgcgggaaccccaggtctacaccttgccaccatgcagggacgaactgacaaagaatcaagtctctctgacctgcctcgtgaaggggttttaccctagcgacattgccgtcgagtgggagtctaacgggcagcccgaaaacaattataagacaaccccaccagtgctggactccgatggctcattctttctctactctaaactcaccgtggataagtcccggtggcagcaagggaatgtgttttcctgctccgtgatgcatgaagctctccacaatcattacacccaaaagagtctgtctctgagccccggc

SEQ ID NO: 58 - DNA, 3015 bp, synthetic construct
  misc_feature 1..3015: note = full length DNA
  source 1..3015: mol_type = other DNA
gacatccagatgacacagagccctagcagcctgtctgccagcgtgggagacagagtgaccattacctgtcaggccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacattgccacctactactgtcagcagggccagacatacccctacacctttggccagggcaccaagctggaaatcaaaggcggaagcagcggcgacatcgtgatgacccaaacacctctgagcctgagcgtgacacctggacagcctgccagcatcagctgcaagtctagccagagcctggtgcacaacaacgccaacacctacctgtcctggtatctccagaaacctggccagtctcctcagagcctcatctataaggtgtccaacagattcagcggcgtgccagacaggtttagcggctctggatctggcacagatttcacactgaagatcagccgcgtggaagccgaggatgtgggcgtgtactattgcggccagggaacacagtaccctttcacctttggaagcggcacaaaggtcgagatcaaaggtggcagctccggcgatattgtgctgacccagtctccagccacactgtctcttagccctggcgagagagccacaatcagctgtagagccagccagtccgtgtccagctacggccagggtttcatgcattggtatcaacaaaagcctggccagccacctcggctgctgatatatggcgcttccagcagagccacaggcatccctgctagattttccggcagcggctccggcacagactttactctgacaatctccccactggaacccgaggacttcgccgtgtattactgccagcagaacaaagaggacccctggacctttggcggcggaacaaaacttgagatcaaaggcggcggaggaagcggcggatcaggatctggtggcggaggatctgcttctggaagtggacaggtgcagctggtgcagtctggcgccgaagttgtgaaaccaggcgcctctgtgaaggtgtcctgtaaagccagcggctacacattcaccagctacgccatgcactgggtcaaagaggctccaggccaaggactggaatggatcggctacatctatcccggccaaggcggcaccaactacaaccagaagttccagggcagagctaccctgaccgctgatacctctgccagcaccgcctacatggaactgtccagcctgagaagcgaggataccgccgtgtacttctgcgctagaacaggcggactgcggagagcctactttacctattggggacagggcaccctcgtgaccgtttcttctggcggatcttcaggccaggtccagctcgttgaatctggcggaggtgttgtgcagcctggcagaagcctgagactgtcttgtgccgcctccggcttcacctttaccaaggcctggatgcattgggtccgacaggcccctggaaagcagctggaatgggttgcccagatcaaggacaagagcaactcctacgccacctattacgccgacagcgtgaagggcagattcaccatcagccgggacgacagcaagaacaccctgtacctgcagatgaactccctgagagccgaggacacagccgtctattattgccggggagtgtactacgctctgagcccctttgattactggggccaagggacactcgtgacagtgtctagtggcggcagctctggtcaagtccagctggttcaaagcggagccgaggtcgtgaaacctggggccagcgtgaaagtgtcttgcaaggcctctggctataccttcacctcctactacatccactgggttcgacaagccccaggccagggccttgagtggattggcagtatctaccccggcaacgtgaacaccaattacgcccagaaattccaaggacgggccacactgaccgtggacacctctatctccacagcttatatggaactgagccggctgcggagcgacgacaccgctgtgtattattgcaccagaagccactacggcctggattggaacttcgacgtgtggggcaagggcaccacagtgactgtttctagtgcctctggcggatccggatcttctggctgtcctccatgtcctgctccagaagctgctggcggcccttctggccagcctagggaaccccaggtttacacactgcctccaagcagggacgagctgaccaagaatcaggtgtccctgacctgcctcgtgaagggcttttaccccagcgacattgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctggaggcagcggatcttctggcggaggtggaagtggtggatctggctctggcggttctggatctagcggttcttctggctgtcctccatgtcctgctccagaagctgctggcggcccttctggacagccgcgggaaccccaggtctacaccttgccaccatccagggacgaactgacaaagaatcaagtctctctgacctgcctcgtgaaggggttttaccctagcgacattgccgtcgagtgggagtctaacgggcagcccgaaaacaattataagacaaccccaccagtgctggactccgatggctcattctttctctactctaaactcaccgtggataagtcccggtggcagcaagggaatgtgttttcctgctccgtgatgcatgaagctctccacaatcattacacccaaaagagtctgtctctgagccccggc

SEQ ID NO: 59 - DNA, 3003 bp, synthetic construct
  misc_feature 1..3003: note = full length DNA
  source 1..3003: mol_type = other DNA
gacatccagatgacacagagccctagcagcctgtctgccagcgtgggagacagagtgaccattacctgtcaggccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacattgccacctactactgtcagcagggccagacatacccctacacctttggccagggcaccaagctggaaatcaaaggcggaagcagcggcgacatcgtgatgacccaaacacctctgagcctgagcgtgacacctggacagcctgccagcatcagctgcaagtctagccagagcctggtgcacaacaacgccaacacctacctgtcctggtatctccagaaacctggccagtctcctcagagcctcatctataaggtgtccaacagattcagcggcgtgccagacaggtttagcggctctggatctggcacagatttcacactgaagatcagccgcgtggaagccgaggatgtgggcgtgtactattgcggccagggaacacagtaccctttcacctttggaagcggcacaaaggtcgagatcaaaggtggcagctccggcgatattgtgctgacccagtctccagccacactgtctcttagccctggcgagagagccacaatcagctgtagagccagccagtccgtgtccagctacggccagggtttcatgcattggtatcaacaaaagcctggccagccacctcggctgctgatatatggcgcttccagcagagccacaggcatccctgctagattttccggcagcggctccggcacagactttactctgacaatctccccactggaacccgaggacttcgccgtgtattactgccagcagaacaaagaggacccctggacctttggcggcggaacaaaacttgagatcaaaggcggcggaggaagcggcggatcaggatctggtggcggaggatctgcttctggaagtggacaggtgcagctggtgcagtctggcgccgaagttgtgaaaccaggcgcctctgtgaaggtgtcctgtaaagccagcggctacacattcaccagctacgccatgcactgggtcaaagaggctccaggccaaggactggaatggatcggctacatctatcccggccaaggcggcaccaactacaaccagaagttccagggcagagctaccctgaccgctgatacctctgccagcaccgcctacatggaactgtccagcctgagaagcgaggataccgccgtgtacttctgcgctagaacaggcggactgcggagagcctactttacctattggggacagggcaccctcgtgaccgtttcttctggcggatcttcaggccaggtccagctcgttgaatctggcggaggtgttgtgcagcctggcagaagcctgagactgtcttgtgccgcctccggcttcacctttaccaaggcctggatgcattgggtccgacaggcccctggaaagcagctggaatgggttgcccagatcaaggacaagagcaactcctacgccacctattacgccgacagcgtgaagggcagattcaccatcagccgggacgacagcaagaacaccctgtacctgcagatgaactccctgagagccgaggacacagccgtctattattgccggggagtgtactacgctctgagcccctttgattactggggccaagggacactcgtgacagtgtctagtggcggcagctctggtcaagtccagctggttcaaagcggagccgaggtcgtgaaacctggggccagcgtgaaagtgtcttgcaaggcctctggctataccttcacctcctactacatccactgggttcgacaagccccaggccagggccttgagtggattggcagtatctaccccggcaacgtgaacaccaattacgcccagaaattccaaggacgggccacactgaccgtggacacctctatctccacagcttatatggaactgagccggctgcggagcgacgacaccgctgtgtattattgcaccagaagccactacggcctggattggaacttcgacgtgtggggcaagggcaccacagtgactgtttctagtgcctctggcggatccggatcttgtcctccatgtcctgctccagaagctgctggcggcagttctggccagcctagggaaccccaggtttacacactgcctccaagcagggacgagctgaccaagaatcaggtgtccctgacctgcctcgtgaagggcttttaccccagcgacattgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctggaggcagcggatcttctggcggaggtggaagtggtggatctggctctggcggttctggatctagcggttcttgtcctccatgtcctgctccagaagctgctggcggcagttctggacagccgcgggaaccccaggtctacaccttgccaccatccagggacgaactgacaaagaatcaagtctctctgacctgcctcgtgaaggggttttaccctagcgacattgccgtcgagtgggagtctaacgggcagcccgaaaacaattataagacaaccccaccagtgctggactccgatggctcattctttctctactctaaactcaccgtggataagtcccggtggcagcaagggaatgtgttttcctgctccgtgatgcatgaagctctccacaatcattacacccaaaagagtctgtctctgagccccggc

SEQ ID NO: 60 - DNA, 2889 bp, synthetic construct
  misc_feature 1..2889: note = full length DNA
  source 1..2889: mol_type = other DNA
gacatccagatgacacagagccctagcagcctgtctgccagcgtgggagacagagtgaccattacctgtcaggccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacattgccacctactactgtcagcagggccagacatacccctacacctttggccagggcaccaagctggaaatcaaaggcggaagcagcggcgacatcgtgatgacccaaacacctctgagcctgagcgtgacacctggacagcctgccagcatcagctgcaagtctagccagagcctggtgcacaacaacgccaacacctacctgtcctggtatctccagaaacctggccagtctcctcagagcctcatctataaggtgtccaacagattcagcggcgtgccagacaggtttagcggctctggatctggcacagatttcacactgaagatcagccgcgtggaagccgaggatgtgggcgtgtactattgcggccagggaacacagtaccctttcacctttggaagcggcacaaaggtcgagatcaaaggtggcagctccggcgatattgtgctgacccagtctccagccacactgtctcttagccctggcgagagagccacaatcagctgtagagccagccagtccgtgtccagctacggccagggtttcatgcattggtatcaacaaaagcctggccagccacctcggctgctgatatatggcgcttccagcagagccacaggcatccctgctagattttccggcagcggctccggcacagactttactctgacaatctccccactggaacccgaggacttcgccgtgtattactgccagcagaacaaagaggacccctggacctttggcggcggaacaaaacttgagatcaaaggcggcggaggaagcggcggatcaggatctggtggcggaggatctgcttctggaagtggacaggtgcagctggtgcagtctggcgccgaagttgtgaaaccaggcgcctctgtgaaggtgtcctgtaaagccagcggctacacattcaccagctacgccatgcactgggtcaaagaggctccaggccaaggactggaatggatcggctacatctatcccggccaaggcggcaccaactacaaccagaagttccagggcagagctaccctgaccgctgatacctctgccagcaccgcctacatggaactgtccagcctgagaagcgaggataccgccgtgtacttctgcgctagaacaggcggactgcggagagcctactttacctattggggacagggcaccctcgtgaccgtttcttctggcggatcttcaggccaggtccagctcgttgaatctggcggaggtgttgtgcagcctggcagaagcctgagactgtcttgtgccgcctccggcttcacctttaccaaggcctggatgcattgggtccgacaggcccctggaaagcagctggaatgggttgcccagatcaaggacaagagcaactcctacgccacctattacgccgacagcgtgaagggcagattcaccatcagccgggacgacagcaagaacaccctgtacctgcagatgaactccctgagagccgaggacacagccgtctattattgccggggagtgtactacgctctgagcccctttgattactggggccaagggacactcgtgacagtgtctagtggcggcagctctggtcaagtccagctggttcaaagcggagccgaggtcgtgaaacctggggccagcgtgaaagtgtcttgcaaggcctctggctataccttcacctcctactacatccactgggttcgacaagccccaggccagggccttgagtggattggcagtatctaccccggcaacgtgaacaccaattacgcccagaaattccaaggacgggccacactgaccgtggacacctctatctccacagcttatatggaactgagccggctgcggagcgacgacaccgctgtgtattattgcaccagaagccactacggcctggattggaacttcgacgtgtggggcaagggcaccacagtgactgtttctagtgcctctggcggatccggagacaagacccacacctgtcctccatgtcctgctccagaagctgctggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggaaccccaggtttacacactgcctccaagcagggacgagctgaccaagaatcaggtgtccctgacctgcctcgtgaagggcttttaccccagcgacattgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctgga

SEQ ID NO: 61 - DNA, 1776 bp, synthetic construct
  misc_feature 1..1776: note = full length DNA
  source 1..1776: mol_type = other DNA
gacatccagctgacacagagccctgcttctctggccgtgtctctgggacagagagccaccatcagctgcaaggccagccagagcgttgactacgacggcgacagctacctgaactggtatcagcagatccccggccagcctcctaagctgctgatctacgatgccagcaacctggtgtctggcatccctcctagattttccggcagcggctctggcaccgacttcaccctgaatatccatcctgtggaaaaggtggacgccgccacctaccactgtcagcagagcacagaagatccctggacctttggcggaggcaccaagctggaaatcaagggaggcggaggatctggcggatctggaagtggcggcggtggatctgcttctggctctggccaggttcagctgcagcagtctggcgccgaactcgttagacctggcagcagcgtgaagatcagctgcaaggccagcggctacgccttcagcagctactggatgaactgggtcaagcagaggcctggacagggcctcgagtggatcggacaaatttggcctggcgacggcgacaccaactacaacggcaagttcaagggcaaagccacactgaccgccgacgagtctagcagcacagcctacatgcagctgtctagcctggccagcgaagatagcgccgtgtacttctgtgccagacgggaaaccaccaccgtgggcagatattactacgccatggactactggggccagggcaccacagtgacagtctcttctgccagcggaggtagcacagtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgtgataagacccacacatgtcctccatgtcctgctccagaagctgccggcggaccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctggctgcccctatcgagaaaaccatcagcaaggccaagggccagcctagggaaccccaggtttacacccttcctccatgccgggatgagctgaccaagaaccaggtgtccctgtggtgtctggtcaagggcttctaccccagcgacattgccgtggaatgggagagcaatggccagcctgagaacaactacaagaccacacctcctgtgctggactccgacggatcattcttcctgtacagcaagctgactgtggacaagagcagatggcagcagggcaacgtgttcagctgcagcgtgatgcacgaggccctgcacaaccactacacacagaagtccctgtctctgagccctggc

SEQ ID NO: 62 - DNA, 2175 bp, synthetic construct
  misc_feature 1..2175: note = full length DNA
  source 1..2175: mol_type = other DNA
gacatccagctgacacagagccctgcttctctggccgtgtctctgggacagagagccaccatcagctgcaaggccagccagagcgttgactacgacggcgacagctacctgaactggtatcagcagatccccggccagcctcctaagctgctgatctacgatgccagcaacctggtgtctggcatccctcctagattttccggcagcggctctggcaccgacttcaccctgaatatccatcctgtggaaaaggtggacgccgccacctaccactgtcagcagagcacagaagatccctggacctttggcggaggcaccaagctggaaatcaaaggcggaagcagcggcgacatcgtgctgactcagtctccagccatcctgtctgctagccctggcgagaaagtgaccatgacctgtagagccagcagcagcgtgaactacatggattggtatcagaagaagcccggcagcagccccaagccttggatctacgccacaagcaatctggccagcggagtgcctgccagattttctggctctggaagcggcaccagctacagcctgacaatcagcagagtggaagccgaggatgccgccacttactattgccagcagtggtccttcaatcctcctaccttcggaggcggaacaaagcttgagatcaaaggtggcggaggaagcggcggatctggatctggcggcggaggatctgctagtggaagcggagaagttcagctgcagcagtctggcgccgagcttgtgaaacctggcgcctctgtgaagatgtcttgcaaggcctccggctacaccttcaccagctataacatgcactgggtcaagcagacccctggacagggcctcgaatggatcggagccatctatcccggcaacggcgacacctcctacaaccagaagttcaagggcaaagccacactgaccgccgacaagagcagcagcacagcctacatgcagctgagcagcctgaccagcgaggacagcgccgattactactgcgccagaagcaactactacggcagctcctactggttcttcgacgtgtggggagccggcaccacagtgacagttagttctggcggaagctccggccaggtgcagcttcaacaaagcggagccgaacttgtgcggcctggctctagcgtgaagatcagctgtaaagccagtggctacgcctttagcagctactggatgaattgggtcaaacagcggccaggccagggacttgagtggatcggacaaatttggcctggcgacggcgataccaactacaatggcaagtttaaaggcaaggctaccctgacagccgacgagtctagctccaccgcttatatgcagctgtctagcctggcctccgaggactccgccgtgtacttttgcgctcggagagagacaaccaccgtcggcagatattactacgccatggactactggggccagggcacaaccgtgacagtgtctagtgctagtggcggctccggagataagacccacacatgtcctccatgtcctgctccagaagctgccggcggaccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctggctgcccctatcgagaaaaccatcagcaaggccaagggccagcctagggaaccccaggtttacacccttcctccatgccgggatgagctgaccaagaaccaggtgtccctgtggtgtctggtcaagggcttctaccccagcgacattgccgtggaatgggagagcaatggccagcctgagaacaactacaagaccacacctcctgtgctggactccgacggatcattcttcctgtacagcaagctgactgtggacaagagcagatggcagcagggcaacgtgttcagctgcagcgtgatgcacgaggccctgcacaaccactacacacagaagtccctgtctctgagccctggc

SEQ ID NO: 63 - DNA, 2175 bp, synthetic construct
  misc_feature 1..2175: note = full length DNA
  source 1..2175: mol_type = other DNA
gacatcgtgctgacacagagccctgccatcctgagtgctagccctggcgagaaagtgaccatgacctgtagagccagcagcagcgtgaactacatggactggtatcagaagaagcccggcagcagccccaagccttggatctacgccacaagcaatctggccagcggagtgcctgccagattttctggctctggcagcggcacaagctacagcctgacaatcagcagagtggaagccgaggatgccgccacctactactgtcagcagtggtccttcaatcctcctaccttcggcggaggcaccaagctggaaatcaaaggcggaagcagcggcgacatccagctgactcaatctccagcctctctggccgtgtcactgggacagagagccaccatcagctgcaaggccagccagtccgtggactacgatggcgacagctacctgaattggtatcagcagatccccggccagcctcctaagctgctgatctacgatgccagcaacctggtgtctggcatccctcctagattttccggcagcggaagcggcaccgacttcaccctgaatatccatcctgtggaaaaggtggacgccgccacatatcactgccagcagagcaccgaagatccctggacatttggaggcggaacaaagcttgagatcaaaggtggcggaggctccggcggatctggatctggcggcggaggatctgctagtggatctggacaggttcagctgcagcagtctggcgccgaactcgttagacctggcagctccgtgaagatcagctgtaaagcctccggctacgccttcagcagctactggatgaactgggtcaagcagaggccaggccagggcctcgaatggatcggacaaatttggcctggcgacggcgacaccaactacaacggcaagttcaagggcaaagccacactgaccgccgacgagtctagcagcacagcctacatgcagctgtctagcctggctagcgaggacagcgccgtgtacttctgcgctagaagagagacaaccaccgtcggccggtactactacgccatggattattggggccagggcaccaccgtgacagtgtcaagtggtggatcttccggcgaggtgcagcttcagcaaagcggagccgaactggtcaaacctggcgcaagcgtgaagatgtcttgcaaggcctctggctacacctttacgagctacaacatgcattgggttaagcagacccctggccaaggacttgagtggatcggcgccatctatcccggcaatggcgacacctcctacaatcagaagtttaaaggcaaggctaccctcaccgccgacaagagcagctctaccgcttatatgcagctgagcagcctgacctccgaggactccgccgattactactgtgccagaagcaactactacggctcctcctactggttcttcgacgtgtggggagccggcacaacagtgactgtgtctagcgctagtggcggctccggagataagacccacacatgtcctccatgtcctgctccagaagctgccggcggaccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctggctgcccctatcgagaaaaccatcagcaaggccaagggccagcctagggaaccccaggtttacacccttcctccatgccgggatgagctgaccaagaaccaggtgtccctgtggtgtctggtcaagggcttctaccccagcgacattgccgtggaatgggagagcaatggccagcctgagaacaactacaagaccacacctcctgtgctggactccgacggatcattcttcctgtacagcaagctgactgtggacaagagcagatggcagcagggcaacgtgttcagctgcagcgtgatgcacgaggccctgcacaaccactacacacagaagtccctgtctctgagccctggc

SEQ ID NO: 64 - protein, 5 aa, synthetic construct
  REGION 1..5: note = CD3 heavy chain CDR1
KAWMH

SEQ ID NO: 65 - protein, 19 aa, synthetic construct
  REGION 1..19: note = CD3 heavy chain CDR2
QIKDKSNSYATYYADSVKG

SEQ ID NO: 66 - protein, 10 aa, synthetic construct
  REGION 1..10: note = CD3 heavy chain CDR3
VYYALSPFDY

SEQ ID NO: 67 - protein, 16 aa, synthetic construct
  REGION 1..16: note = CD3 light chain CDR1
KSSQSLVHNNANTYLS

SEQ ID NO: 68 - protein, 7 aa, synthetic construct
  REGION 1..7: note = CD3 light chain CDR2
KVSNRFS

SEQ ID NO: 69 - protein, 9 aa, synthetic construct
  REGION 1..9: note = CD3 light chain CDR3
GQGTQYPFT

SEQ ID NO: 70 - protein, 5 aa, synthetic construct
  REGION 1..5: note = CD19 heavy chain CDR1
SYWMN

SEQ ID NO: 71 - protein, 17 aa, synthetic construct
  REGION 1..17: note = CD19 heavy chain CDR2
QIWPGDGDTNYNGKFKG

SEQ ID NO: 72 - protein, 15 aa, synthetic construct
  REGION 1..15: note = CD19 heavy chain CDR3
RETTTVGRYYYAMDY

SEQ ID NO: 73 - protein, 15 aa, synthetic construct
  REGION 1..15: note = CD19 light chain CDR1
KASQSVDYDGDSYLN

SEQ ID NO: 74 - protein, 7 aa, synthetic construct
  REGION 1..7: note = CD19 light chain CDR2
DASNLVS

SEQ ID NO: 75 - protein, 9 aa, synthetic construct
  REGION 1..9: note = CD19 light chain CDR3
QQSTEDPWT

SEQ ID NO: 76 - protein, 5 aa, synthetic construct
  REGION 1..5: note = CD20 heavy chain CDR1
SYNMH

SEQ ID NO: 77 - protein, 17 aa, synthetic construct
  REGION 1..17: note = CD20 heavy chain CDR2
AIYPGNGDTSYNQKFKG

SEQ ID NO: 78 - protein, 13 aa, synthetic construct
  REGION 1..13: note = CD20 heavy chain CDR3
SNYYGSSYWFFDV

SEQ ID NO: 79 - protein, 10 aa, synthetic construct
  REGION 1..10: note = CD20 light chain CDR1
RASSSVNYMD

SEQ ID NO: 80 - protein, 7 aa, synthetic construct
  REGION 1..7: note = CD20 light chain CDR2
ATSNLAS

SEQ ID NO: 81 - protein, 9 aa, synthetic construct
  REGION 1..9: note = CD20 light chain CDR3
QQWSFNPPT

SEQ ID NO: 82 - protein, 5 aa, synthetic construct
  REGION 1..5: note = CD28 heavy chain CDR1
SYYIH

SEQ ID NO: 83 - protein, 17 aa, synthetic construct
  REGION 1..17: note = CD28 heavy chain CDR2
SIYPGNVNTNYAQKFQG

SEQ ID NO: 84 - protein, 11 aa, synthetic construct
  REGION 1..11: note = CD28 heavy chain CDR3
SHYGLDWNFDV

SEQ ID NO: 85 - protein, 11 aa, synthetic construct
  REGION 1..11: note = CD28 light chain CDR1
QASQNIYVWLN

SEQ ID NO: 86 - protein, 7 aa, synthetic construct
  REGION 1..7: note = CD28 light chain CDR2
KASNLHT

SEQ ID NO: 87 - protein, 9 aa, synthetic construct
  REGION 1..9: note = CD28 light chain CDR3
QQGQTYPYT

SEQ ID NO: 88 - protein, 5 aa, synthetic construct
  REGION 1..5: note = CD38 heavy chain CDR1
SYAMH

SEQ ID NO: 89 - protein, 17 aa, synthetic construct
  REGION 1..17: note = CD38 heavy chain CDR2
YIYPGQGGTNYNQKFQG

SEQ ID NO: 90 - protein, 11 aa, synthetic construct
  REGION 1..11: note = CD38 heavy chain CDR3
TGGLRRAYFTY

SEQ ID NO: 91 - protein, 15 aa, synthetic construct
  REGION 1..15: note = CD38 light chain CDR1
RASQSVSSYGQGFMH

SEQ ID NO: 92 - protein, 7 aa, synthetic construct
  REGION 1..7: note = CD38 light chain CDR2
GASSRAT

SEQ ID NO: 93 - protein, 9 aa, synthetic construct
  REGION 1..9: note = CD38 light chain CDR3
QQNKEDPWT

SEQ ID NO: 94 - protein, 960 aa, synthetic construct
  REGION 1..960: note = aCD33aCD123LHaBCMAL1knobLALAPA
DIQLTQSPSTLSASVGDRVTITCRASESLDNYGIRFLTWFQQKPGKAPKLLMYAASNQGSGVPSRFSGSGSGTEFTLTISSLQPDDFATYYCQQTKEVPWSFGQGTKVEVKGGSSGDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKGGSSGDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKGGGGSGGSGSGGGGSASGSGQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSGGSSGEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSGGSSGEVQLVQSGAEVKKPGSSVKVSCKASGYTITDSNIHWVRQAPGQSLEWIGYIYPYNGGTDYNQKFKNRATLTVDNPTNTAYMELSSLRSEDTAFYYCVNGNPWLAYWGQGTLVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 95 - DNA, 2880 bp, synthetic construct
  misc_feature 1..2880: note = aCD33aCD123LHaBCMAL1knobLALAPA
  source 1..2880: mol_type = other DNA
gatatccagctgacacaaagcccatccactctttctgctagcgtgggcgaccgggtcaccattacctgtcgcgcctccgagagtttggacaattacggtatacggttcctcacatggttccaacagaagccggggaaggctcccaaactgctgatgtacgcggccagcaatcagggatcaggagtccccagtcgattctccgggagtggttccggtacagagtttactctgacgatttcaagcctgcagcctgacgatttcgcaacgtactattgtcagcagactaaggaagtgccttggagtttcgggcagggaactaaggttgaggtcaaaggcggaagcagcggcgacattgtaatgactcaatctcctgactccctcgcagtgagcctgggcgagcgtgcaacgattaattgcgaaagctctcagagtcttctcaactctggcaaccaaaaaaattacttaacatggtaccagcagaaacctggtcagcctccaaaacctcttatatattgggcctccacaagggagagcggagtgccagataggttttccggttctggatctggcactgatttcacattgactatcagctcactccaggctgaagatgtcgccgtctattactgtcagaatgattacagctatccttatacatttggccagggtaccaaactggagatcaagggtggcagctccggcgacattcaaatgacccagagtccctcatccctgtcagcctcggttggggatcgagtcaccatcacctgttcagcaagtcaggacatctccaattatcttaattggtatcagcaaaaacccggaaaggccccaaagctcttaatttactatacatctaatctgcattccggggtaccgagcagatttagtggcagcggaagcgggactgattttacactcaccatttcatctctgcaacccgaggactttgccacatattattgccaacaatacagaaaactgccatggaccttcggtcagggcacgaagctggaaataaagggcggcggaggaagcggcggatcaggatctggtggcggaggatctgcttctggaagtggacaagtgcagttggtacagtctggtgcggaggtgaagaaacctgggagcagcgtgaaagtttcctgcaaagcttccggtgggacgttttcaaactattggatgcactgggtccgtcaggcaccggggcagggcctcgagtggatgggcgctacctataggggtcacagcgatacgtactacaaccagaagtttaagggcagagtaactataaccgctgacaagtctacctcgactgcctacatggagctgtcgtcattaaggtctgaagataccgcagtgtactactgtgcccgcggcgccatctatgacgggtatgacgttctggataattggggacagggaacacttgttaccgtatccagtggcggatcttcaggcgaagtgcagctggtccagtctggagcggaggtgaagaagcccggtgaaagcctaaaaatctcctgtaaggggtccgggtatagtttcaccgactactacatgaagtgggcacgccagatgcccgggaagggactcgagtggatgggcgacattattcctagtaacggcgccacattttacaaccagaagttcaagggccaggtcaccatctctgctgataagagcatctcaaccacttacttgcagtggagctctcttaaagcctctgataccgccatgtattattgcgcgaggagccacttattgcgggcatcttggttcgcctactggggccagggcactatggtcaccgtgagttcaggcggcagctctggtgaggtgcaactggttcagtctggcgccgaagtgaagaaacccggatcttcagtgaaggtgtcgtgcaaagcgagtgggtataccatcaccgactctaacatccattgggtgagacaagcccccggacagagcctagaatggatcggatatatatacccatacaacggggggacagactacaatcaaaaattcaaaaaccgggcaacactaacagtggacaacccaaccaacacagcttatatggaattgtcgtccctgcgctccgaggatactgctttttactactgcgtgaatggcaacccatggctggcttactgggggcagggaactctcgttactgtgtcctcagcttctggcggctccggagataagacccacacatgtcctccatgtcctgctccagaagctgctggcggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggaaccccaggtttacacccttcctccatgccgggatgagctgaccaagaaccaggtgtccctgtggtgtctcgtgaagggcttctaccccagcgacattgccgtggaatgggagagcaatggccagcctgagaacaactacaagacaacccctcctgtgctggacagcgacggctcattcttcctgtacagcaagctgacagtcgacaagtccagatggcagcagggcaacgtgttcagttgcagcgtgatgcacgaggccctgcacaaccactacacccagaagtccctgagcctgtctcctgga

SEQ ID NO: 96 - protein, 960 aa, synthetic construct
  REGION 1..960: note = aCD33aCD123LHaBCMAL1knobLALAPA
DIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKGGSSGDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKGGSSGDIQLTQSPSTLSASVGDRVTITCRASESLDNYGIRFLTWFQQKPGKAPKLLMYAASNQGSGVPSRFSGSGSGTEFTLTISSLQPDDFATYYCQQTKEVPWSFGQGTKVEVKGGGGSGGSGSGGGGSASGSGEVQLVQSGAEVKKPGSSVKVSCKASGYTITDSNIHWVRQAPGQSLEWIGYIYPYNGGTDYNQKFKNRATLTVDNPTNTAYMELSSLRSEDTAFYYCVNGNPWLAYWGQGTLVTVSSGGSSGQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSGGSSGEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 97 - DNA, 2880 bp, synthetic construct
  misc_feature 1..2880: note = aCD33aCD123LHaBCMAL1knobLALAPA
  source 1..2880: mol_type = other DNA
gacattgtaatgactcaatctcctgactccctcgcagtgagcctgggcgagcgtgcaacgattaattgcgaaagctctcagagtcttctcaactctggcaaccaaaaaaattacttaacatggtaccagcagaaacctggtcagcctccaaaacctcttatatattgggcctccacaagggagagcggagtgccagataggttttccggttctggatctggcactgatttcacattgactatcagctcactccaggctgaagatgtcgccgtctattactgtcagaatgattacagctatccttatacatttggccagggtaccaaactggagatcaagggcggaagcagcggcgacattcaaatgacccagagtccctcatccctgtcagcctcggttggggatcgagtcaccatcacctgttcagcaagtcaggacatctccaattatcttaattggtatcagcaaaaacccggaaaggccccaaagctcttaatttactatacatctaatctgcattccggggtaccgagcagatttagtggcagcggaagcgggactgattttacactcaccatttcatctctgcaacccgaggactttgccacatattattgccaacaatacagaaaactgccatggaccttcggtcagggcacgaagctggaaataaagggtggcagctccggcgatatccagctgacacaaagcccatccactctttctgctagcgtgggcgaccgggtcaccattacctgtcgcgcctccgagagtttggacaattacggtatacggttcctcacatggttccaacagaagccggggaaggctcccaaactgctgatgtacgcggccagcaatcagggatcaggagtccccagtcgattctccgggagtggttccggtacagagtttactctgacgatttcaagcctgcagcctgacgatttcgcaacgtactattgtcagcagactaaggaagtgccttggagtttcgggcagggaactaaggttgaggtcaaaggcggcggaggaagcggcggatcaggatctggtggcggaggatctgcttctggaagtggagaggtgcaactggttcagtctggcgccgaagtgaagaaacccggatcttcagtgaaggtgtcgtgcaaagcgagtgggtataccatcaccgactctaacatccattgggtgagacaagcccccggacagagcctagaatggatcggatatatatacccatacaacggggggacagactacaatcaaaaattcaaaaaccgggcaacactaacagtggacaacccaaccaacacagcttatatggaattgtcgtccctgcgctccgaggatactgctttttactactgcgtgaatggcaacccatggctggcttactgggggcagggaactctcgttactgtgtcctcaggcggatcttcaggccaagtgcagttggtacagtctggtgcggaggtgaagaaacctgggagcagcgtgaaagtttcctgcaaagcttccggtgggacgttttcaaactattggatgcactgggtccgtcaggcaccggggcagggcctcgagtggatgggcgctacctataggggtcacagcgatacgtactacaaccagaagtttaagggcagagtaactataaccgctgacaagtctacctcgactgcctacatggagctgtcgtcattaaggtctgaagataccgcagtgtactactgtgcccgcggcgccatctatgacgggtatgacgttctggataattggggacagggaacacttgttaccgtatccagtggcggcagctctggtgaagtgcagctggtccagtctggagcggaggtgaagaagcccggtgaaagcctaaaaatctcctgtaaggggtccgggtatagtttcaccgactactacatgaagtgggcacgccagatgcccgggaagggactcgagtggatgggcgacattattcctagtaacggcgccacattttacaaccagaagttcaagggccaggtcaccatctctgctgataagagcatctcaaccacttacttgcagtggagctctcttaaagcctctgataccgccatgtattattgcgcgaggagccacttattgcgggcatcttggttcgcctactggggccagggcactatggtcaccgtgagttcagcttctggcggctccggagataagacccacacatgtcctccatgtcctgctccagaagctgctggcggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggaaccccaggtttacacccttcctccatgccgggatgagctgaccaagaaccaggtgtccctgtggtgtctcgtgaagggcttctaccccagcgacattgccgtggaatgggagagcaatggccagcctgagaacaactacaagacaacccctcctgtgctggacagcgacggctcattcttcctgtacagcaagctgacagtcgacaagtccagatggcagcagggcaacgtgttcagttgcagcgtgatgcacgaggccctgcacaaccactacacccagaagtccctgagcctgtctcctgga

SEQ ID NO: 98 - protein, 490 aa, synthetic construct
  REGION 1..490: note = TgCD28bCD3csL1His8
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSHHHHHHHH

SEQ ID NO: 99 - protein, 502 aa, synthetic construct
  REGION 1..502: note = bCD19dCD38L1His8
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGSSGEIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKGGGGSGGSGSGGGGSASGSGEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSGGSSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSHHHHHHHH

SEQ ID NO: 100 - protein, 722 aa, synthetic construct
  REGION 1..722: note = aCD28aCD3L1LALAPA
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGSSGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGGGSGGSGSGGGGSASGSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGSSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 101 - protein, 722 aa, synthetic construct
  REGION 1..722: note = aCD28aCD3L2LALAPA
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGTVAADIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGGGSGGSGSGGGGSASGSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASTGGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 102 - protein, 722 aa, synthetic construct
  REGION 1..722: note = aCD3csaCD28L1LALAPA
DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGGSSGDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGGGSGGSGSGGGGSASGSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSGGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 103 - protein, 722 aa, synthetic construct
  REGION 1..722: note = aCD3csaCD28L2LALAPA
DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGTVAADIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKGGGGSGGSGSGGGGSASGSGQVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASTGGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 104 - protein, 714 aa, synthetic construct
  REGION 1..714: note = TgCD28bCD3csL1holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 105 - protein, 714 aa, synthetic construct
  REGION 1..714: note = bCD3csTgCD28L1holeLALAPA
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGGGSGGSGSGGGGSASGSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 106 - protein, 721 aa, synthetic construct
  REGION 1..721: note = bCD3csTgCD28L1CLCH1Fc(hole)LALAPA
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGGGSGGSGSGGGGSASGSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGSGSGGGGSASGSGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 107 - protein, 721 aa, synthetic construct
  REGION 1..721: note = bCD3csTgCD28L1CLCH1Fc(hole)LALAPA
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGGGSGGSGSGGGGSASGSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGSGSGGGGSASGSGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPC

SEQ ID NO: 108 - protein, 480 aa, synthetic construct
  REGION 1..480: note = TgCD28bCD3csL3holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSG

SEQ ID NO: 109 - protein, 498 aa, synthetic construct
  REGION 1..498: note = TgCD28bCD3csL4holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKSGGSGSSGGSDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSGGSSGSSQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSG

SEQ ID NO: 110 - protein, 595 aa, synthetic construct
  REGION 1..595: note = TgCD28bCD3csL1CH1rw1holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCP

SEQ ID NO: 111 - protein, 595 aa, synthetic construct
  REGION 1..595: note = TgCD28bCD3csL1CH1rw2holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSSDKTHTCPPCP

SEQ ID NO: 112 - protein, 597 aa, synthetic construct
  REGION 1..597: note = TgCD28bCD3csL1CH1rw3 holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKTPLGDTTHTCPPCP

SEQ ID NO: 113 - protein, 598 aa, synthetic construct
  REGION 1..598: note = TgCD28bCD3csL1CH1rw4holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCP

SEQ ID NO: 114 - protein, 600 aa, synthetic construct
  REGION 1..600: note = TgCD28bCD3csL1CH1rw5holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGSSGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCP

SEQ ID NO: 115 - protein, 488 aa, synthetic construct
  REGION 1..488: note = TgCD28bCD3csL1HHLLholeLALAPA
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGGGSGGSGSGGGGSASGSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKASGGSG

SEQ ID NO: 116 - protein, 488 aa, synthetic construct
  REGION 1..488: note = bCD3csTgCD28L1HHLLholeLALAPA
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGGGSGGSGSGGGGSASGSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKASGGSG

SEQ ID NO: 117 - protein, 595 aa, synthetic construct
  REGION 1..595: note = TgCD28bCD3csL1CH1rw1holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDKTHTCPPCPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSG

SEQ ID NO: 118 - protein, 600 aa, synthetic construct; identical to SEQ ID NO: 114
  REGION 1..600: note = TgCD28bCD3csL1CH1rw5holeLALAPA

SEQ ID NO: 119 - protein, 483 aa, synthetic construct
  REGION 1..483: note = CD38scFvKnobLALAPA
DIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGGGSGGSGSGGGGSASGSGQVQLVQSGAEVVKPGASVKVSCKASGYTFTSYAMHWVKEAPGQRLEWIGYIYPGQGGTNYNQKFQGRATLTADTSASTAYMELSSLRSEDTAVYFCARTGGLRRAYFTYWGQGTLVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 120 - protein, 449 aa, synthetic construct
  REGION 1..449: note = CD38HKnobLALAPA
QVQLVQSGAEVVKPGASVKVSCKASGYTFTSYAMHWVKEAPGQRLEWIGYIYPGQGGTNYNQKFQGRATLTADTSASTAYMELSSLRSEDTAVYFCARTGGLRRAYFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 121 - protein, 218 aa, synthetic construct
  REGION 1..218: note = CD38L
DIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 122 - protein, 487 aa, synthetic construct
  REGION 1..487: note = CD19scFvKnobLALAPA
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGSGSGGGGSASGSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 123 - protein, 453 aa, synthetic construct
  REGION 1..453: note = CD19HKnobLALAPA
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 124 - protein, 218 aa, synthetic construct
  REGION 1..218: note = CD19L
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 125 - protein, 490 aa, synthetic construct
  REGION 1..490: note = CD38scFabKnobLALAPA
DIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSGGGGSGGGGSGGGGSGGGGSQVQLVQSGAEVVKPGASVKVSCKASGYTFTSYAMHWVKEAPGQRLEWIGYIYPGQGGTNYNQKFQGRATLTADTSASTAYMELSSLRSEDTAVYFCARTGGLRRAYFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 126 - protein, 490 aa, synthetic construct
  REGION 1..490: note = CD38scCH1CL1KnobLALAPA
QVQLVQSGAEVVKPGASVKVSCKASGYTFTSYAMHWVKEAPGQRLEWIGYIYPGQGGTNYNQKFQGRATLTADTSASTAYMELSSLRSEDTAVYFCARTGGLRRAYFTYWGQGTLVTVSSGGGGSGGSGSGGGGSASGSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGSGSGGGGSASGSGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 127 - protein, 487 aa, synthetic construct
  REGION 1..487: note = CD38scCH1CL2KnobLALAPA
QVQLVQSGAEVVKPGASVKVSCKASGYTFTSYAMHWVKEAPGQRLEWIGYIYPGQGGTNYNQKFQGRATLTADTSASTAYMELSSLRSEDTAVYFCARTGGLRRAYFTYWGQGTLVTVSSGGGGSGGSGSGGGGSASGSGDIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGSGGSGSGGGSASGSGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 128 - protein, 372 aa, synthetic construct
  REGION 1..372: note = bCD19scFvL1CLrw1knobLALAPA
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGSGSGGGGSASGSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSATVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCP

SEQ ID NO: 129 - protein, 489 aa, synthetic construct
  REGION 1..489: note = dCD38scFvL1CLrw1knobLALAPA
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKGGGGSGGSGSGGGGSASGSGEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSAEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSATVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCP

SEQ ID NO: 130 - protein, 376 aa, synthetic construct
  REGION 1..376: note = bCD19scFvL1CLrw5knobLALAPA
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGSGSGGGGSASGSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASGGSTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCP

SEQ ID NO: 131 - protein, 370 aa, synthetic construct
  REGION 1..370: note = dCD38scFvL1CLrw5knobLALAPA
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKGGGGSGGSGSGGGGSASGSGEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASGGSTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCP

SEQ ID NO: 132 - protein, 720 aa, synthetic construct
  REGION 1..720: note = PGT121VRC01L1holeFc
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGGSSGLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKGGGGSGGSGSGGGGSASGSGQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSGGSSGQMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 133 - protein, 720 aa, synthetic construct
  REGION 1..720: note = VRC01PGT121L1holeFc
LTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKGGSSGSDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGGGGSGGSGSGGGGSASGSGQMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSGGSSGQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 134 - protein, 748 aa, synthetic construct
  REGION 1..748: note = 10e8v4PG16L1knob
SELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVLGGSSGQSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVLGGGGSGGSGSGGGGSASGSGQEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSSGGSSGEVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 135 - protein, 748 aa, synthetic construct
  REGION 1..748: note = PG1610e8v4L1knob
QSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVLGGSSGSELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVLGGGGSGGSGSGGGGSASGSGEVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSSGGSSGQEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 136 - protein, 738 aa, synthetic construct
  REGION 1..738: note = PGT12110e8v4L1holeFc
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGGSSGSELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVLGGGGSGGSGSGGGGSASGSGEVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSSGGSSGQMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 137 - protein, 738 aa, synthetic construct
  REGION 1..738: note = 10e8v4PGT121L1holeFc
SELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVLGGSSGSDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGGGGSGGSGSGGGGSASGSGQMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSGGSSGEVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 138 - protein, 730 aa, synthetic construct
  REGION 1..730: note = VRC01PG16L1knob
LTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKGGSSGQSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVLGGGGSGGSGSGGGGSASGSGQEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSSGGSSGQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 139 - protein, 730 aa, synthetic construct
  REGION 1..730: note = PG16VRC01L1knob
QSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVLGGSSGLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKGGGGSGGSGSGGGGSASGSGQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSGGSSGQEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 140 - protein, 746 aa, synthetic construct
  REGION 1..746: note = PGT121PG16L1holeFc
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGGSSGQSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVLGGGGSGGSGSGGGGSASGSGQEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSSGGSSGQMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 141 - protein, 746 aa, synthetic construct
  REGION 1..746: note = PG16PGT121L1holeFc
QSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVLGGSSGSDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGGGGSGGSGSGGGGSASGSGQMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSGGSSGQEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 142 - protein, 722 aa, synthetic construct
  REGION 1..722: note = VRC0110e8v4L1knob
LTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKGGSSGSELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVLGGGGSGGSGSGGGGSASGSGEVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSSGGSSGQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 143 - protein, 722 aa, synthetic construct
  REGION 1..722: note = 10e8v4VRC01L1knob
SELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVLGGSSGLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKGGGGSGGSGSGGGGSASGSGQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSGGSSGEVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 144 - DNA, 2169 bp, synthetic construct
  misc_feature 1..2169: note = PGT121VRC01L1holeFc
  source 1..2169: mol_type = other DNA
agcgatatctctgtggcccctggcgagacagccagaatcagctgtggcgagaagtccctgggaagcagagccgtgcagtggtatcagcatagagccggacaggcccctagcctgatcatctacaacaaccaggacagacccagcggcatccccgagagattttctggcagccctgatagccctttcggcaccacagccacactgaccatcacatctgtggaagccggcgacgaggccgactactactgtcacatctgggacagcagggtgcccaccaaatgggttttcggcggaggcacaaccctgaccgttctgggcggatcttctggagagatcgtgctgacacagagccctggcaccctgagcctgtctccaggcgagacagccatcatcagctgccggacaagccagtacggcagcctggcctggtatcagcagaggcctggacaggcccccagactcgtgatctacagcggcagcacaagagccgccggaatccccgatagattcagcggctccagatggggccctgactacaacctgaccatcagcaacctggaaagcggcgacttcggcgtgtactactgccagcagtacgagttcttcggccagggcaccaaggtgcaggtggacatcaagggaggcggaggatctggcggatctggaagtggcggcggtggatctgcttctggctctggccaggttcagctggttcagtctggcggacagatgaagaaacccggcgagagcatgcggatcagctgtagagccagcggctacgagttcatcgactgcaccctgaactggatcagactggcccctggcaaaagacccgagtggatgggatggctgaagcctagaggcggagccgtgaattacgccagacctctgcagggcagagtgaccatgaccagggacgtgtacagcgataccgccttcctggaactgagaagcctgaccgtggatgataccgccgtgtacttctgcacccggggcaagaactgcgactacaactgggacttcgagcactggggcagaggcacacctgtgatcgttagctctggcggatcttctggacagatgcagctccaagagtctggccctggcctggtcaagcctagcgaaacactgagcctgacctgttccgtgtccggcgccagcatcagcgatagctactggtcctggatcagaagaagccccggcaaaggcctggaatggatcggctacgtgcacaagagcggcgacaccaactatagccccagcctgaagtccagagtgaacctgagcctggacaccagcaagaaccaggtgtccctgtctctggtggccgctacagctgccgatagcggcaagtactactgcgccagaactctgcacggcagacggatctatggcatcgtggccttcaacgagtggttcacctacttctacatggacgtgtggggcaacggcacccaagtgacagtctcttctgcaagcggaggctccggagataagacccacacatgtcctccatgtcctgctccagagctgctgggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 145 - DNA, 2169 bp, synthetic construct
  misc_feature 1..2169: note = VRC01PGT121L1holeFc
  source 1..2169: mol_type = other DNA
gagatcgtgctgacacagagccctggcaccctgagcctgtctccaggcgagacagccatcatcagctgccggacaagccagtacggcagcctggcctggtatcagcagaggcctggacaggcccccagactcgtgatctacagcggcagcacaagagccgccggaatccccgatagattcagcggctccagatggggccctgactacaacctgaccatcagcaacctggaaagcggcgacttcggcgtgtactactgccagcagtacgagttcttcggccagggcaccaaggtgcaggtggacatcaagggcggatcttctggaagcgatatctctgtggcccctggcgagacagccagaatcagctgtggcgagaagtccctgggaagcagagccgtgcagtggtatcagcatagagccggacaggcccctagcctgatcatctacaacaaccaggacagacccagcggcatccccgagagattttctggcagccctgatagccctttcggcaccacagccacactgaccatcacatctgtggaagccggcgacgaggccgactactactgtcacatctgggacagcagggtgcccaccaaatgggttttcggcggaggcacaaccctgaccgttctgggaggcggaggatctggcggatctggaagtggcggcggtggatctgcttctggctctggccagatgcagctccaagagtctggccctggcctggtcaagcctagcgaaacactgagcctgacctgttccgtgtccggcgccagcatcagcgatagctactggtcctggatcagaagaagccccggcaaaggcctggaatggatcggctacgtgcacaagagcggcgacaccaactatagccccagcctgaagtccagagtgaacctgagcctggacaccagcaagaaccaggtgtccctgtctctggtggccgctacagctgccgatagcggcaagtactactgcgccagaactctgcacggcagacggatctatggcatcgtggccttcaacgagtggttcacctacttctacatggacgtgtggggcaacggcacccaagtgacagtctcttctggcggatcttctggacaggttcagctggttcagtctggcggacagatgaagaaacccggcgagagcatgcggatcagctgtagagccagcggctacgagttcatcgactgcaccctgaactggatcagactggcccctggcaaaagacccgagtggatgggatggctgaagcctagaggcggagccgtgaattacgccagacctctgcagggcagagtgaccatgaccagggacgtgtacagcgataccgccttcctggaactgagaagcctgaccgtggatgataccgccgtgtacttctgcacccggggcaagaactgcgactacaactgggacttcgagcactggggcagaggcacacctgtgatcgttagctctgcaagcggaggctccggagataagacccacacatgtcctccatgtcctgctccagagctgctgggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 146 - DNA, 2244 bp, synthetic construct
  misc_feature 1..2244: note = 10e8v4PG16L1knob
  source 1..2244: mol_type = other DNA
agcgaactgacccaagatcctgccgtgtctgtggccctgaagcagaccgtgaccatcacctgtagaggcgacagcctgagaagccactacgccagctggtatcagaagaagcctggacaggctcccgtgctgctgttctacggcaagaacaacagacccagcggcatccccgatagattttctggcagcgccagcggcaatagagccagcctgacaattactggcgcccaggccgaagatgaggccgactactactgcagcagcagagacaagagcggcagcagactgtccgtttttggcggaggcaccaagctgaccgtgctgggcggatcttctggacagtctgctctgacacagcctgcctctgtgtctggctctcctggccagaccatcaccatcagctgtaacggcaccagctctgacgtcggcggctttgatagcgtgtcctggtatcagcagagccccggcaaagcccctaaagtgatggtgttcgatgtgtcccaccggcctagcggcatcagcaatagattcagcggcagcaagagcggcaacaccgccagcctgacaatctctggactgcacatcgaggacgagggcgactacttctgtagcagcctgaccgacagaagccaccggatttttggcggaggcaccaaagtgaccgtgctgggaggcggaggatctggcggatctggaagtggcggcggtggatctgcttctggctctggccaagaacagctggtggaatctggtggcggagtggttcaacctggcggctctctgagactgagctgtctggcctccggcttcaccttccacaaatacggcatgcactgggtccgacaggcccctggaaaaggccttgaatgggtcgccctgatcagcgacgacggcatgagaaagtaccacagcgacagcatgtggggcagagtgaccatcagccgggacaacagcaagaacaccctgtacctgcagttcagctccctgaaggtggaagataccgccatgttcttttgcgccagagaagccggcggacccatctggcatgacgacgtgaagtactacgacttcaacgacggctactacaactaccactacatggacgtgtggggcaagggcaccaccgtgacagtttcttctggcggatcttctggagaagttcggctggtggaatctggcggcggacttgtgaaacctggcggctctctgagactgagctgtagcgcctccggcttcgacttcgacaatgcctggatgacctgggtccgacagcctcctggaaaaggcctggaatgggtcggaagaatcacaggccctggcgaaggctggagtgtggattatgccgagagcgtgaagggcagattcaccatcagccgggacaacaccaagaacaccctgtacctggaaatgaacaacgtgcggaccgaggataccggctactacttctgtgcccggaccggcaagtactacgacttttggagcggctaccctcctggcgaggaatactttcaggattggggccagggcaccctggtcatcgtttcttctgcaagcggaggctccggagataagacccacacatgtcctccatgtcctgctccagaactgctgggcggaccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctgcccgcccctatcgagaaaaccatcagcaaggccaagggccagcctagggaaccccaggtttacacccttcctccatgccgggatgagctgaccaagaaccaggtgtccctgtggtgtctggtcaagggcttctaccccagcgacattgccgtggaatgggagagcaatggccagcctgagaacaactacaagaccacacctcctgtgctggactccgacggatcattcttcctgtacagcaagctgactgtggacaagagcagatggcagcagggcaacgtgttcagctgcagcgtgatgcacgaggccctgcacaaccactacacacagaagtccctgtctctgagccctggc

SEQ ID NO: 147 - DNA, 2244 bp, synthetic construct
  misc_feature 1..2244: note = PG1610e8v4L1knob
  source 1..2244: mol_type = other DNA
cagtctgctctgacacagcctgcctctgtgtctggctctcctggccagaccatcaccatcagctgtaacggcaccagctctgacgtcggcggctttgatagcgtgtcctggtatcagcagagccccggcaaagcccctaaagtgatggtgttcgatgtgtcccaccggcctagcggcatcagcaatagattcagcggcagcaagagcggcaacaccgccagcctgacaatctctggactgcacatcgaggacgagggcgactacttctgtagcagcctgaccgacagaagccaccggatttttggcggaggcaccaaagtgaccgtgctgggcggatcttctggaagcgaactgacccaagatcctgccgtgtctgtggccctgaagcagaccgtgaccatcacctgtagaggcgacagcctgagaagccactacgccagctggtatcagaagaagcctggacaggctcccgtgctgctgttctacggcaagaacaacagacccagcggcatccccgatagattttctggcagcgccagcggcaatagagccagcctgacaattactggcgcccaggccgaagatgaggccgactactactgcagcagcagagacaagagcggcagcagactgtccgtttttggcggaggcaccaagctgaccgtgctgggaggcggaggatctggcggatctggaagtggcggcggtggatctgcttctggctctggcgaagttcggctggtggaatctggcggcggacttgtgaaacctggcggctctctgagactgagctgtagcgcctccggcttcgacttcgacaatgcctggatgacctgggtccgacagcctcctggaaaaggcctggaatgggtcggaagaatcacaggccctggcgaaggctggagtgtggattatgccgagagcgtgaagggcagattcaccatcagccgggacaacaccaagaacaccctgtacctggaaatgaacaacgtgcggaccgaggataccggctactacttctgtgcccggaccggcaagtactacgacttttggagcggctaccctcctggcgaggaatactttcaggattggggccagggcaccctggtcatcgtttcttctggcggatcttctggacaagaacagctggtggaatctggtggcggagtggttcaacctggcggctctctgagactgagctgtctggcctccggcttcaccttccacaaatacggcatgcactgggtccgacaggcccctggaaaaggccttgaatgggtcgccctgatcagcgacgacggcatgagaaagtaccacagcgacagcatgtggggcagagtgaccatcagccgggacaacagcaagaacaccctgtacctgcagttcagctccctgaaggtggaagataccgccatgttcttttgcgccagagaagccggcggacccatctggcatgacgacgtgaagtactacgacttcaacgacggctactacaactaccactacatggacgtgtggggcaagggcaccaccgtgacagtttcttctgcaagcggaggctccggagataagacccacacatgtcctccatgtcctgctccagaactgctgggcggaccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctgcccgcccctatcgagaaaaccatcagcaaggccaagggccagcctagggaaccccaggtttacacccttcctccatgccgggatgagctgaccaagaaccaggtgtccctgtggtgtctggtcaagggcttctaccccagcgacattgccgtggaatgggagagcaatggccagcctgagaacaactacaagaccacacctcctgtgctggactccgacggatcattcttcctgtacagcaagctgactgtggacaagagcagatggcagcagggcaacgtgttcagctgcagcgtgatgcacgaggccctgcacaaccactacacacagaagtccctgtctctgagccctggc

SEQ ID NO: 148 - DNA, 2214 bp, synthetic construct
  misc_feature 1..2214: note = PGT12110e8v4L1holeFc
  source 1..2214: mol_type = other DNA
agcgatatctctgtggcccctggcgagacagccagaatcagctgtggcgagaagtccctgggaagcagagccgtgcagtggtatcagcatagagccggacaggcccctagcctgatcatctacaacaaccaggacagacccagcggcatccccgagagattttctggcagccctgatagccctttcggcaccacagccacactgaccatcacatctgtggaagccggcgacgaggccgactactactgtcacatctgggacagcagggtgcccaccaaatgggttttcggcggaggcacaaccctgaccgttctgggcggatcttctggaagcgaactgacccaagatcctgccgtgtctgtggccctgaagcagaccgtgaccatcacctgtagaggcgacagcctgagaagccactacgccagctggtatcagaagaagcctggacaggctcccgtgctgctgttctacggcaagaacaacagacccagcggcatccccgatagattttctggcagcgccagcggcaatagagccagcctgacaattactggcgcccaggccgaagatgaggccgactactactgcagcagcagagacaagagcggcagcagactgtccgtttttggcggaggcaccaagctgaccgtgctgggaggcggaggatctggcggatctggaagtggcggcggtggatctgcttctggctctggcgaagttcggctggtggaatctggcggcggacttgtgaaacctggcggctctctgagactgagctgtagcgcctccggcttcgacttcgacaatgcctggatgacctgggtccgacagcctcctggaaaaggcctggaatgggtcggaagaatcacaggccctggcgaaggctggagtgtggattatgccgagagcgtgaagggcagattcaccatcagccgggacaacaccaagaacaccctgtacctggaaatgaacaacgtgcggaccgaggataccggctactacttctgtgcccggaccggcaagtactacgacttttggagcggctaccctcctggcgaggaatactttcaggattggggccagggcaccctggtcatcgtttcttctggcggatcttctggacagatgcagctccaagagtctggccctggcctggtcaagcctagcgaaacactgagcctgacctgttccgtgtccggcgccagcatcagcgatagctactggtcctggatcagaagaagccccggcaaaggcctggaatggatcggctacgtgcacaagagcggcgacaccaactatagccccagcctgaagtccagagtgaacctgagcctggacaccagcaagaaccaggtgtccctgtctctggtggccgctacagctgccgatagcggcaagtactactgcgccagaactctgcacggcagacggatctatggcatcgtggccttcaacgagtggttcacctacttctacatggacgtgtggggcaacggcacccaagtgacagtctcttctgcaagcggaggctccggagataagacccacacatgtcctccatgtcctgctccagagctgctgggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 149 - DNA, 2214 bp, synthetic construct
  misc_feature 1..2214: note = 10e8v4PGT121L1holeFc
  source 1..2214: mol_type = other DNA
agcgaactgacccaagatcctgccgtgtctgtggccctgaagcagaccgtgaccatcacctgtagaggcgacagcctgagaagccactacgccagctggtatcagaagaagcctggacaggctcccgtgctgctgttctacggcaagaacaacagacccagcggcatccccgatagattttctggcagcgccagcggcaatagagccagcctgacaattactggcgcccaggccgaagatgaggccgactactactgcagcagcagagacaagagcggcagcagactgtccgtttttggcggaggcaccaagctgaccgtgctgggcggatcttctggaagcgatatctctgtggcccctggcgagacagccagaatcagctgtggcgagaagtccctgggaagcagagccgtgcagtggtatcagcatagagccggacaggcccctagcctgatcatctacaacaaccaggacagacccagcggcatccccgagagattttctggcagccctgatagccctttcggcaccacagccacactgaccatcacatctgtggaagccggcgacgaggccgactactactgtcacatctgggacagcagggtgcccaccaaatgggttttcggcggaggcacaaccctgaccgttctgggaggcggaggatctggcggatctggaagtggcggcggtggatctgcttctggctctggccagatgcagctccaagagtctggccctggcctggtcaagcctagcgaaacactgagcctgacctgttccgtgtccggcgccagcatcagcgatagctactggtcctggatcagaagaagccccggcaaaggcctggaatggatcggctacgtgcacaagagcggcgacaccaactatagccccagcctgaagtccagagtgaacctgagcctggacaccagcaagaaccaggtgtccctgtctctggtggccgctacagctgccgatagcggcaagtactactgcgccagaactctgcacggcagacggatctatggcatcgtggccttcaacgagtggttcacctacttctacatggacgtgtggggcaacggcacccaagtgacagtctcttctggcggatcttctggagaagttcggctggtggaatctggcggcggacttgtgaaacctggcggctctctgagactgagctgtagcgcctccggcttcgacttcgacaatgcctggatgacctgggtccgacagcctcctggaaaaggcctggaatgggtcggaagaatcacaggccctggcgaaggctggagtgtggattatgccgagagcgtgaagggcagattcaccatcagccgggacaacaccaagaacaccctgtacctggaaatgaacaacgtgcggaccgaggataccggctactacttctgtgcccggaccggcaagtactacgacttttggagcggctaccctcctggcgaggaatactttcaggattggggccagggcaccctggtcatcgtttcttctgcaagcggaggctccggagataagacccacacatgtcctccatgtcctgctccagagctgctgggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 150 - DNA, 2199 bp, synthetic construct
  misc_feature 1..2199: note = VRC01PG16L1knob
  source 1..2199: mol_type = other DNA
gagatcgtgctgacacagagccctggcaccctgagcctgtctccaggcgagacagccatcatcagctgccggacaagccagtacggcagcctggcctggtatcagcagaggcctggacaggcccccagactcgtgatctacagcggcagcacaagagccgccggaatccccgatagattcagcggctccagatggggccctgactacaacctgaccatcagcaacctggaaagcggcgacttcggcgtgtactactgccagcagtacgagttcttcggccagggcaccaaggtgcaggtggacatcaagggcggatcttctggacagtctgctctgacacagcctgcctctgtgtctggctctcctggccagaccatcaccatcagctgtaacggcaccagctctgacgtcggcggctttgatagcgtgtcctggtatcagcagagccccggcaaagcccctaaagtgatggtgttcgatgtgtcccaccggcctagcggcatcagcaatagattcagcggcagcaagagcggcaacaccgccagcctgacaatctctggactgcacatcgaggacgagggcgactacttctgtagcagcctgaccgacagaagccaccggatttttggcggaggcaccaaagtgaccgtgctgggaggcggaggatctggcggatctggaagtggcggcggtggatctgcttctggctctggccaagaacagctggtggaatctggtggcggagtggttcaacctggcggctctctgagactgagctgtctggcctccggcttcaccttccacaaatacggcatgcactgggtccgacaggcccctggaaaaggccttgaatgggtcgccctgatcagcgacgacggcatgagaaagtaccacagcgacagcatgtggggcagagtgaccatcagccgggacaacagcaagaacaccctgtacctgcagttcagctccctgaaggtggaagataccgccatgttcttttgcgccagagaagccggcggacccatctggcatgacgacgtgaagtactacgacttcaacgacggctactacaactaccactacatggacgtgtggggcaagggcaccaccgtgacagtttcttctggcggatcttctggacaggttcagctggttcagtctggcggacagatgaagaaacccggcgagagcatgcggatcagctgtagagccagcggctacgagttcatcgactgcaccctgaactggatcagactggcccctggcaaaagacccgagtggatgggatggctgaagcctagaggcggagccgtgaattacgccagacctctgcagggcagagtgaccatgaccagggacgtgtacagcgataccgccttcctggaactgagaagcctgaccgtggatgataccgccgtgtacttctgcacccggggcaagaactgcgactacaactgggacttcgagcactggggcagaggcacacctgtgatcgttagctctgcaagcggaggctccggagataagacccacacatgtcctccatgtcctgctccagaactgctgggcggaccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctgcccgcccctatcgagaaaaccatcagcaaggccaagggccagcctagggaaccccaggtttacacccttcctccatgccgggatgagctgaccaagaaccaggtgtccctgtggtgtctggtcaagggcttctaccccagcgacattgccgtggaatgggagagcaatggccagcctgagaacaactacaagaccacacctcctgtgctggactccgacggatcattcttcctgtacagcaagctgactgtggacaagagcagatggcagcagggcaacgtgttcagctgcagcgtgatgcacgaggccctgcacaaccactacacacagaagtccctgtctctgagccctggc

SEQ ID NO: 151 - DNA, 2199 bp, synthetic construct
  misc_feature 1..2199: note = PG16VRC01L1knob
  source 1..2199: mol_type = other DNA
cagtctgctctgacacagcctgcctctgtgtctggctctcctggccagaccatcaccatcagctgtaacggcaccagctctgacgtcggcggctttgatagcgtgtcctggtatcagcagagccccggcaaagcccctaaagtgatggtgttcgatgtgtcccaccggcctagcggcatcagcaatagattcagcggcagcaagagcggcaacaccgccagcctgacaatctctggactgcacatcgaggacgagggcgactacttctgtagcagcctgaccgacagaagccaccggatttttggcggaggcaccaaagtgaccgtgctgggcggatcttctggagagatcgtgctgacacagagccctggcaccctgagcctgtctccaggcgagacagccatcatcagctgccggacaagccagtacggcagcctggcctggtatcagcagaggcctggacaggcccccagactcgtgatctacagcggcagcacaagagccgccggaatccccgatagattcagcggctccagatggggccctgactacaacctgaccatcagcaacctggaaagcggcgacttcggcgtgtactactgccagcagtacgagttcttcggccagggcaccaaggtgcaggtggacatcaagggaggcggaggatctggcggatctggaagtggcggcggtggatctgcttctggctctggccaggttcagctggttcagtctggcggacagatgaagaaacccggcgagagcatgcggatcagctgtagagccagcggctacgagttcatcgactgcaccctgaactggatcagactggcccctggcaaaagacccgagtggatgggatggctgaagcctagaggcggagccgtgaattacgccagacctctgcagggcagagtgaccatgaccagggacgtgtacagcgataccgccttcctggaactgagaagcctgaccgtggatgataccgccgtgtacttctgcacccggggcaagaactgcgactacaactgggacttcgagcactggggcagaggcacacctgtgatcgttagctctggcggatcttctggacaagaacagctggtggaatctggtggcggagtggttcaacctggcggctctctgagactgagctgtctggcctccggcttcaccttccacaaatacggcatgcactgggtccgacaggcccctggaaaaggccttgaatgggtcgccctgatcagcgacgacggcatgagaaagtaccacagcgacagcatgtggggcagagtgaccatcagccgggacaacagcaagaacaccctgtacctgcagttcagctccctgaaggtggaagataccgccatgttcttttgcgccagagaagccggcggacccatctggcatgacgacgtgaagtactacgacttcaacgacggctactacaactaccactacatggacgtgtggggcaagggcaccaccgtgacagtttcttctgcaagcggaggctccggagataagacccacacatgtcctccatgtcctgctccagaactgctgggcggaccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctgcccgcccctatcgagaaaaccatcagcaaggccaagggccagcctagggaaccccaggtttacacccttcctccatgccgggatgagctgaccaagaaccaggtgtccctgtggtgtctggtcaagggcttctaccccagcgacattgccgtggaatgggagagcaatggccagcctgagaacaactacaagaccacacctcctgtgctggactccgacggatcattcttcctgtacagcaagctgactgtggacaagagcagatggcagcagggcaacgtgttcagctgcagcgtgatgcacgaggccctgcacaaccactacacacagaagtccctgtctctgagccctggc

SEQ ID NO: 152 - DNA, 2238 bp, synthetic construct
  misc_feature 1..2238: note = PGT121PG16L1holeFc
  source 1..2238: mol_type = other DNA
agcgatatctctgtggcccctggcgagacagccagaatcagctgtggcgagaagtccctgggaagcagagccgtgcagtggtatcagcatagagccggacaggcccctagcctgatcatctacaacaaccaggacagacccagcggcatccccgagagattttctggcagccctgatagccctttcggcaccacagccacactgaccatcacatctgtggaagccggcgacgaggccgactactactgtcacatctgggacagcagggtgcccaccaaatgggttttcggcggaggcacaaccctgaccgttctgggcggatcttctggacagtctgctctgacacagcctgcctctgtgtctggctctcctggccagaccatcaccatcagctgtaacggcaccagctctgacgtcggcggctttgatagcgtgtcctggtatcagcagagccccggcaaagcccctaaagtgatggtgttcgatgtgtcccaccggcctagcggcatcagcaatagattcagcggcagcaagagcggcaacaccgccagcctgacaatctctggactgcacatcgaggacgagggcgactacttctgtagcagcctgaccgacagaagccaccggatttttggcggaggcaccaaagtgaccgtgctgggaggcggaggatctggcggatctggaagtggcggcggtggatctgcttctggctctggccaagaacagctggtggaatctggtggcggagtggttcaacctggcggctctctgagactgagctgtctggcctccggcttcaccttccacaaatacggcatgcactgggtccgacaggcccctggaaaaggccttgaatgggtcgccctgatcagcgacgacggcatgagaaagtaccacagcgacagcatgtggggcagagtgaccatcagccgggacaacagcaagaacaccctgtacctgcagttcagctccctgaaggtggaagataccgccatgttcttttgcgccagagaagccggcggacccatctggcatgacgacgtgaagtactacgacttcaacgacggctactacaactaccactacatggacgtgtggggcaagggcaccaccgtgacagtttcttctggcggatcttctggacagatgcagctccaagagtctggccctggcctggtcaagcctagcgaaacactgagcctgacctgttccgtgtccggcgccagcatcagcgatagctactggtcctggatcagaagaagccccggcaaaggcctggaatggatcggctacgtgcacaagagcggcgacaccaactatagccccagcctgaagtccagagtgaacctgagcctggacaccagcaagaaccaggtgtccctgtctctggtggccgctacagctgccgatagcggcaagtactactgcgccagaactctgcacggcagacggatctatggcatcgtggccttcaacgagtggttcacctacttctacatggacgtgtggggcaacggcacccaagtgacagtctcttctgcaagcggaggctccggagataagacccacacatgtcctccatgtcctgctccagagctgctgggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 153 - DNA, 2238 bp, synthetic construct
  misc_feature 1..2238: note = PG16PGT121L1holeFc
  source 1..2238: mol_type = other DNA
cagtctgctctgacacagcctgcctctgtgtctggctctcctggccagaccatcaccatcagctgtaacggcaccagctctgacgtcggcggctttgatagcgtgtcctggtatcagcagagccccggcaaagcccctaaagtgatggtgttcgatgtgtcccaccggcctagcggcatcagcaatagattcagcggcagcaagagcggcaacaccgccagcctgacaatctctggactgcacatcgaggacgagggcgactacttctgtagcagcctgaccgacagaagccaccggatttttggcggaggcaccaaagtgaccgtgctgggcggatcttctggaagcgatatctctgtggcccctggcgagacagccagaatcagctgtggcgagaagtccctgggaagcagagccgtgcagtggtatcagcatagagccggacaggcccctagcctgatcatctacaacaaccaggacagacccagcggcatccccgagagattttctggcagccctgatagccctttcggcaccacagccacactgaccatcacatctgtggaagccggcgacgaggccgactactactgtcacatctgggacagcagggtgcccaccaaatgggttttcggcggaggcacaaccctgaccgttctgggaggcggaggatctggcggatctggaagtggcggcggtggatctgcttctggctctggccagatgcagctccaagagtctggccctggcctggtcaagcctagcgaaacactgagcctgacctgttccgtgtccggcgccagcatcagcgatagctactggtcctggatcagaagaagccccggcaaaggcctggaatggatcggctacgtgcacaagagcggcgacaccaactatagccccagcctgaagtccagagtgaacctgagcctggacaccagcaagaaccaggtgtccctgtctctggtggccgctacagctgccgatagcggcaagtactactgcgccagaactctgcacggcagacggatctatggcatcgtggccttcaacgagtggttcacctacttctacatggacgtgtggggcaacggcacccaagtgacagtctcttctggcggatcttctggacaagaacagctggtggaatctggtggcggagtggttcaacctggcggctctctgagactgagctgtctggcctccggcttcaccttccacaaatacggcatgcactgggtccgacaggcccctggaaaaggccttgaatgggtcgccctgatcagcgacgacggcatgagaaagtaccacagcgacagcatgtggggcagagtgaccatcagccgggacaacagcaagaacaccctgtacctgcagttcagctccctgaaggtggaagataccgccatgttcttttgcgccagagaagccggcggacccatctggcatgacgacgtgaagtactacgacttcaacgacggctactacaactaccactacatggacgtgtggggcaagggcaccaccgtgacagtttcttctgcaagcggaggctccggagataagacccacacatgtcctccatgtcctgctccagagctgctgggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 154 - DNA, 2175 bp, synthetic construct
  misc_feature 1..2175: note = VRC0110e8v4L1knob
  source 1..2175: mol_type = other DNA
gagatcgtgctgacacagagccctggcaccctgagcctgtctccaggcgagacagccatcatcagctgccggacaagccagtacggcagcctggcctggtatcagcagaggcctggacaggcccccagactcgtgatctacagcggcagcacaagagccgccggaatccccgatagattcagcggctccagatggggccctgactacaacctgaccatcagcaacctggaaagcggcgacttcggcgtgtactactgccagcagtacgagttcttcggccagggcaccaaggtgcaggtggacatcaagggcggatcttctggaagcgaactgacccaagatcctgccgtgtctgtggccctgaagcagaccgtgaccatcacctgtagaggcgacagcctgagaagccactacgccagctggtatcagaagaagcctggacaggctcccgtgctgctgttctacggcaagaacaacagacccagcggcatccccgatagattttctggcagcgccagcggcaatagagccagcctgacaattactggcgcccaggccgaagatgaggccgactactactgcagcagcagagacaagagcggcagcagactgtccgtttttggcggaggcaccaagctgaccgtgctgggaggcggaggatctggcggatctggaagtggcggcggtggatctgcttctggctctggcgaagttcggctggtggaatctggcggcggacttgtgaaacctggcggctctctgagactgagctgtagcgcctccggcttcgacttcgacaatgcctggatgacctgggtccgacagcctcctggaaaaggcctggaatgggtcggaagaatcacaggccctggcgaaggctggagtgtggattatgccgagagcgtgaagggcagattcaccatcagccgggacaacaccaagaacaccctgtacctggaaatgaacaacgtgcggaccgaggataccggctactacttctgtgcccggaccggcaagtactacgacttttggagcggctaccctcctggcgaggaatactttcaggattggggccagggcaccctggtcatcgtttcttctggcggatcttctggacaggttcagctggttcagtctggcggacagatgaagaaacccggcgagagcatgcggatcagctgtagagccagcggctacgagttcatcgactgcaccctgaactggatcagactggcccctggcaaaagacccgagtggatgggatggctgaagcctagaggcggagccgtgaattacgccagacctctgcagggcagagtgaccatgaccagggacgtgtacagcgataccgccttcctggaactgagaagcctgaccgtggatgataccgccgtgtacttctgcacccggggcaagaactgcgactacaactgggacttcgagcactggggcagaggcacacctgtgatcgttagctctgcaagcggaggctccggagataagacccacacatgtcctccatgtcctgctccagaactgctgggcggaccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctgcccgcccctatcgagaaaaccatcagcaaggccaagggccagcctagggaaccccaggtttacacccttcctccatgccgggatgagctgaccaagaaccaggtgtccctgtggtgtctggtcaagggcttctaccccagcgacattgccgtggaatgggagagcaatggccagcctgagaacaactacaagaccacacctcctgtgctggactccgacggatcattcttcctgtacagcaagctgactgtggacaagagcagatggcagcagggcaacgtgttcagctgcagcgtgatgcacgaggccctgcacaaccactacacacagaagtccctgtctctgagccctggc

SEQ ID NO: 155 - DNA, 2175 bp, synthetic construct
  misc_feature 1..2175: note = 10e8v4VRC01L1knob
  source 1..2175: mol_type = other DNA
agcgaactgacccaagatcctgccgtgtctgtggccctgaagcagaccgtgaccatcacctgtagaggcgacagcctgagaagccactacgccagctggtatcagaagaagcctggacaggctcccgtgctgctgttctacggcaagaacaacagacccagcggcatccccgatagattttctggcagcgccagcggcaatagagccagcctgacaattactggcgcccaggccgaagatgaggccgactactactgcagcagcagagacaagagcggcagcagactgtccgtttttggcggaggcaccaagctgaccgtgctgggcggatcttctggagagatcgtgctgacacagagccctggcaccctgagcctgtctccaggcgagacagccatcatcagctgccggacaagccagtacggcagcctggcctggtatcagcagaggcctggacaggcccccagactcgtgatctacagcggcagcacaagagccgccggaatccccgatagattcagcggctccagatggggccctgactacaacctgaccatcagcaacctggaaagcggcgacttcggcgtgtactactgccagcagtacgagttcttcggccagggcaccaaggtgcaggtggacatcaagggaggcggaggatctggcggatctggaagtggcggcggtggatctgcttctggctctggccaggttcagctggttcagtctggcggacagatgaagaaacccggcgagagcatgcggatcagctgtagagccagcggctacgagttcatcgactgcaccctgaactggatcagactggcccctggcaaaagacccgagtggatgggatggctgaagcctagaggcggagccgtgaattacgccagacctctgcagggcagagtgaccatgaccagggacgtgtacagcgataccgccttcctggaactgagaagcctgaccgtggatgataccgccgtgtacttctgcacccggggcaagaactgcgactacaactgggacttcgagcactggggcagaggcacacctgtgatcgttagctctggcggatcttctggagaagttcggctggtggaatctggcggcggacttgtgaaacctggcggctctctgagactgagctgtagcgcctccggcttcgacttcgacaatgcctggatgacctgggtccgacagcctcctggaaaaggcctggaatgggtcggaagaatcacaggccctggcgaaggctggagtgtggattatgccgagagcgtgaagggcagattcaccatcagccgggacaacaccaagaacaccctgtacctggaaatgaacaacgtgcggaccgaggataccggctactacttctgtgcccggaccggcaagtactacgacttttggagcggctaccctcctggcgaggaatactttcaggattggggccagggcaccctggtcatcgtttcttctgcaagcggaggctccggagataagacccacacatgtcctccatgtcctgctccagaactgctgggcggaccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctgcccgcccctatcgagaaaaccatcagcaaggccaagggccagcctagggaaccccaggtttacacccttcctccatgccgggatgagctgaccaagaaccaggtgtccctgtggtgtctggtcaagggcttctaccccagcgacattgccgtggaatgggagagcaatggccagcctgagaacaactacaagaccacacctcctgtgctggactccgacggatcattcttcctgtacagcaagctgactgtggacaagagcagatggcagcagggcaacgtgttcagctgcagcgtgatgcacgaggccctgcacaaccactacacacagaagtccctgtctctgagccctggc

SEQ ID NO: 156 - protein, 578 aa, synthetic construct
  REGION 1..578: note = ahCD38GS1ahCD3H_hIgG1
QVQLVQSGAEVVKPGASVKVSCKASGYTFTSYAMHWVKEAPGQRLEWIGYIYPGQGGTNYNQKFQGRATLTADTSASTAYMELSSLRSEDTAVYFCARTGGLRRAYFTYWGQGTLVTVSSGGSGSSGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 157 - protein, 337 aa, synthetic construct
  REGION 1..337: note = ahCD38GS1ahCD3L
DIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGGSGSSGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 158 - protein, 577 aa, synthetic construct
  REGION 1..577: note = ahCD38Cl1ahCD3H_hIgG1
QVQLVQSGAEVVKPGASVKVSCKASGYTFTSYAMHWVKEAPGQRLEWIGYIYPGQGGTNYNQKFQGRATLTADTSASTAYMELSSLRSEDTAVYFCARTGGLRRAYFTYWGQGTLVTVSSGPAALVQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 159 - protein, 336 aa, synthetic construct
  REGION 1..336: note = ahCD38Cl1ahCD3L
DIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGPAALVDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 160 - protein, 578 aa, synthetic construct
  REGION 1..578: note = ahCD38Cl2ahCD3H_hIgG1
QVQLVQSGAEVVKPGASVKVSCKASGYTFTSYAMHWVKEAPGQRLEWIGYIYPGQGGTNYNQKFQGRATLTADTSASTAYMELSSLRSEDTAVYFCARTGGLRRAYFTYWGQGTLVTVSSGPLGLTGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 161 - protein, 337 aa, synthetic construct
  REGION 1..337: note = ahCD38Cl2ahCD3L
DIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGPLGLTGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 162 - protein, 578 aa, synthetic construct
  REGION 1..578: note = ahCD38Cl3ahCD3H_hIgG1
QVQLVQSGAEVVKPGASVKVSCKASGYTFTSYAMHWVKEAPGQRLEWIGYIYPGQGGTNYNQKFQGRATLTADTSASTAYMELSSLRSEDTAVYFCARTGGLRRAYFTYWGQGTLVTVSSGPSGLVGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - protein, 337 aa, synthetic construct
  REGION 1..337: note = ahCD38Cl3ahCD3L
DIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGPSGLVGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 164 - protein, 577 aa, synthetic construct
  REGION 1..577: note = ahCD38Cl4ahCD3H_hIgG1
QVQLVQSGAEVVKPGASVKVSCKASGYTFTSYAMHWVKEAPGQRLEWIGYIYPGQGGTNYNQKFQGRATLTADTSASTAYMELSSLRSEDTAVYFCARTGGLRRAYFTYWGQGTLVTVSSGSGRKGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 165 - protein, 336 aa, synthetic construct
  REGION 1..336: note = ahCD38Cl4ahCD3L
DIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKGSGRKGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 166 - protein, 579 aa, synthetic construct
  REGION 1..579: note = ahCD38Cl5ahCD3H_hIgG1
QVQLVQSGAEVVKPGASVKVSCKASGYTFTSYAMHWVKEAPGQRLEWIGYIYPGQGGTNYNQKFQGRATLTADTSASTAYMELSSLRSEDTAVYFCARTGGLRRAYFTYWGQGTLVTVSSASTRKAGGQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 167 - protein, 338 aa, synthetic construct
  REGION 1..338: note = ahCD38Cl5ahCD3L
DIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKASTRKAGGDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 168 - protein, 573 aa, synthetic construct
  REGION 1..573: note = TgCD28csGSbCD3csHholeLALAPA
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 169 - protein, 325 aa, synthetic construct
  REGION 1..325: note = TgCD28csGSbCD3L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSGSDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 170 - protein, 575 aa, synthetic construct
  REGION 1..575: note = TgCD28csCl3bCD3csHholeLALAPA
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGPSGLVGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 171 - protein, 327 aa, synthetic construct
  REGION 1..327: note = TgCD28csMMP13bCD3L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGPSGLVGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 172 - protein, 575 aa, synthetic construct
  REGION 1..575: note = TgCD28csCl6bCD3csHholeLALAPA
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGPAGLVGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 173 - protein, 327 aa, synthetic construct
  REGION 1..327: note = TgCD28csCl6bCD3L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGPAGLVGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 174 - protein, 576 aa, synthetic construct
  REGION 1..576: note = TgCD28csCl7bCD3csHholeLALAPA
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGPAGLVSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 175 - protein, 328 aa, synthetic construct
  REGION 1..328: note = TgCD28csCl7bCD3L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGPAGLVSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 176 - protein, 576 aa, synthetic construct
  REGION 1..576: note = TgCD28cscl5bCD3csHholeLALAPA
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASTRKAGGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 177 - protein, 328 aa, synthetic construct
  REGION 1..328: note = TgCD28cscl5bCD3L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKASTRKAGGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 178 - protein, 575 aa, synthetic construct
  REGION 1..575: note = TgCD28cscl8bCD3csHholeLALAPA
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASTRKAGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 179 - protein, 327 aa, synthetic construct
  REGION 1..327: note = TgCD28cscl8bCD3L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKASTRKAGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 180 - protein, 725 aa, synthetic construct
  REGION 1..725: note = cMetTrop2_317L1knobLALAPA
DIVMTQSPDSLAVSLGERATINCKSSQSLLYTSSQKNYLAWYQQKPGQPPKLLIYWASTRESGVPDRFSGSGSGTDFTLTISSLQAEDVAVYYCQQYYAYPWTFGGGTKLEIKGGSSGEIVLTQSPATLSLSPGERATLSCRASQSVDSYGNSFLHWYQQKPGQAPRLLIYWASNRATGIPARFSGSGSGTDFTLTISSLEPEDFAVYYCQQNNEDLWTFGGGTKLEIKGGGGSGGSGSGGGGSASGSGEVQLVESGGGLVKPGGSLRLSCAASGFTFQNYAMSWVRQAPGKGLEWVSSISSDATYTYYADSVKGRFTISRDNAKNVLYLQMTSLRAEDTAVYYCARHPPSYYYAFDYWGQGTTLTVSSGGSSGQVQLVQSGAEVVKPGASVKLSCKASGYTFTSYWLHWVRQAPGQGLEWVGMIDPSNSDTRFNPNFKDRVTITADTSTSTAYMELSSLRSEDTAVYYCATYKSYVSPLDYWGQGTSVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 181 - protein, 725 aa, synthetic construct
  REGION 1..725: note = Trop2_317cMetL1knobLALAPA
EIVLTQSPATLSLSPGERATLSCRASQSVDSYGNSFLHWYQQKPGQAPRLLIYWASNRATGIPARFSGSGSGTDFTLTISSLEPEDFAVYYCQQNNEDLWTFGGGTKLEIKGGSSGDIVMTQSPDSLAVSLGERATINCKSSQSLLYTSSQKNYLAWYQQKPGQPPKLLIYWASTRESGVPDRFSGSGSGTDFTLTISSLQAEDVAVYYCQQYYAYPWTFGGGTKLEIKGGGGSGGSGSGGGGSASGSGQVQLVQSGAEVVKPGASVKLSCKASGYTFTSYWLHWVRQAPGQGLEWVGMIDPSNSDTRFNPNFKDRVTITADTSTSTAYMELSSLRSEDTAVYYCATYKSYVSPLDYWGQGTSVTVSSGGSSGEVQLVESGGGLVKPGGSLRLSCAASGFTFQNYAMSWVRQAPGKGLEWVSSISSDATYTYYADSVKGRFTISRDNAKNVLYLQMTSLRAEDTAVYYCARHPPSYYYAFDYWGQGTTLTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 182 - protein, 573 aa, synthetic construct
  REGION 1..573: note = TgCD28csGShOKT3HholeLALAPA
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSGSQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 183 - protein, 325 aa, synthetic construct
  REGION 1..325: note = TgCD28csGShOKT3L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSGSDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 184 - protein, 575 aa, synthetic construct
  REGION 1..575: note = TgCD28csCl3hOKT3csHholeLALAPA
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGPSGLVGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 185 - protein, 327 aa, synthetic construct
  REGION 1..327: note = TgCD28csMMP13hOKT3L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGPSGLVGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 186 - protein, 576 aa, synthetic construct
  REGION 1..576: note = TgCD28cscl5hOKT3csHholeLALAPA
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 187 - protein, 328 aa, synthetic construct
  REGION 1..328: note = TgCD28cshep12hOKT3L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKASTRKAGGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 188 - protein, 576 aa, synthetic construct
  REGION 1..576: note = TgCD28csCL10hOKT3csHholeLALAPA
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGLVGRKAGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 189 - protein, 328 aa, synthetic construct
  REGION 1..328: note = TgCD28cs_hybrid1hOKT3L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGLVGRKAGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 190 - protein, 718 aa, synthetic construct
  REGION 1..718: note = cMetTrop2_h20L1knobLALAPA
DIVMTQSPDSLAVSLGERATINCKSSQSLLYTSSQKNYLAWYQQKPGQPPKLLIYWASTRESGVPDRFSGSGSGTDFTLTISSLQAEDVAVYYCQQYYAYPWTFGGGTKLEIKGGSSGDIQMTQSPSSLSASVGDRVTITCQASQDINKYLAWYQKKPGKAPKLLIHYTSNLQTGVPSRFSGSGSGTDFTFTISSLQPEDIATYYCLQYDDLFTFGQGTKLEIKGGGGSGGSGSGGGGSASGSGQVQLVQSGAEVKKPGASVKVSCKASGSSFTGYTMNWVKQAPGQGLEWIGIINPYQGDTTYNQKFQGKVTITVDKSTSTVYMELSSLRSEDTAVYYCARGAGLYYFDYWGQGTTVTVSSGGSSGQVQLVQSGAEVVKPGASVKLSCKASGYTFTSYWLHWVRQAPGQGLEWVGMIDPSNSDTRFNPNFKDRVTITADTSTSTAYMELSSLRSEDTAVYYCATYKSYVSPLDYWGQGTSVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 191 - protein, 718 aa, synthetic construct
  REGION 1..718: note = Trop2_h20cMetL1knobLALAPA
DIQMTQSPSSLSASVGDRVTITCQASQDINKYLAWYQKKPGKAPKLLIHYTSNLQTGVPSRFSGSGSGTDFTFTISSLQPEDIATYYCLQYDDLFTFGQGTKLEIKGGSSGDIVMTQSPDSLAVSLGERATINCKSSQSLLYTSSQKNYLAWYQQKPGQPPKLLIYWASTRESGVPDRFSGSGSGTDFTLTISSLQAEDVAVYYCQQYYAYPWTFGGGTKLEIKGGGGSGGSGSGGGGSASGSGQVQLVQSGAEVVKPGASVKLSCKASGYTFTSYWLHWVRQAPGQGLEWVGMIDPSNSDTRFNPNFKDRVTITADTSTSTAYMELSSLRSEDTAVYYCATYKSYVSPLDYWGQGTSVTVSSGGSSGQVQLVQSGAEVKKPGASVKVSCKASGSSFTGYTMNWVKQAPGQGLEWIGIINPYQGDTTYNQKFQGKVTITVDKSTSTVYMELSSLRSEDTAVYYCARGAGLYYFDYWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 192 - protein, 328 aa, synthetic construct
  REGION 1..328: note = TgCD28cs_ssMMP15hOKT3L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGCGTKVEIKGPAGLVSGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 193 - protein, 576 aa, synthetic construct
  REGION 1..576: note = TgCD28cs_ssMMP15hOKT3H_HNul
QVQLVQSGAEVKKPGASVKVSCKASGYTFTSYYIHWVRQAPGQCLEWIGSIYPGNVNTNYNEKFKDRATLTVDTSISTAYMELSRLRSDDTAVYFCTRSHYGLDWNFDVWGQGTTVTVSSGPAGLVSGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 194 - protein, 573 aa, synthetic construct
  REGION 1..573: note = TgCD28cs_ssGShOKT3HholeLALAPA
QVQLVQSGAEVKKPGASVKVSCKASGYTFTSYYIHWVRQAPGQCLEWIGSIYPGNVNTNYNEKFKDRATLTVDTSISTAYMELSRLRSDDTAVYFCTRSHYGLDWNFDVWGQGTTVTVSSGGSGSQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 195 - protein, 325 aa, synthetic construct
  REGION 1..325: note = TgCD28cs_ssGShOKT3L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGCGTKVEIKGGSGSDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 196 - protein, 328 aa, synthetic construct
  REGION 1..328: note = TgCD28cs_sshep12hOKT3L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGCGTKVEIKASTRKAGGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 197 - protein, 327 aa, synthetic construct
  REGION 1..327: note = TgCD28cs_sshep13hOKT3L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGCGTKVEIKASTRKAGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 198 - protein, 327 aa, synthetic construct
  REGION 1..327: note = TgCD28cs_sshep13bhOKT3L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGCGTKVEIKSTRKAGGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 199 - protein, 576 aa, synthetic construct
  REGION 1..576: note = TgCD28cs_sscl5hOKT3HholeLALAPA
QVQLVQSGAEVKKPGASVKVSCKASGYTFTSYYIHWVRQAPGQCLEWIGSIYPGNVNTNYNEKFKDRATLTVDTSISTAYMELSRLRSDDTAVYFCTRSHYGLDWNFDVWGQGTTVTVSSASTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 200 - protein, 575 aa, synthetic construct
  REGION 1..575: note = TgCD28cs_sscl8hOKT3HholeLALAPA
QVQLVQSGAEVKKPGASVKVSCKASGYTFTSYYIHWVRQAPGQCLEWIGSIYPGNVNTNYNEKFKDRATLTVDTSISTAYMELSRLRSDDTAVYFCTRSHYGLDWNFDVWGQGTTVTVSSASTRKAGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 201 - protein, 575 aa, synthetic construct
  REGION 1..575: note = TgCD28cs_sscl9hOKT3HholeLALAPA
QVQLVQSGAEVKKPGASVKVSCKASGYTFTSYYIHWVRQAPGQCLEWIGSIYPGNVNTNYNEKFKDRATLTVDTSISTAYMELSRLRSDDTAVYFCTRSHYGLDWNFDVWGQGTTVTVSSSTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 202 - protein, 720 aa, synthetic construct
  REGION 1..720: note = Trop2_317TgCD28csL1knobLALAPA
EIVLTQSPATLSLSPGERATLSCRASQSVDSYGNSFLHWYQQKPGQAPRLLIYWASNRATGIPARFSGSGSGTDFTLTISSLEPEDFAVYYCQQNNEDLWTFGGGTKLEIKGGSSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGGGSGGSGSGGGGSASGSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSSGEVQLVESGGGLVKPGGSLRLSCAASGFTFQNYAMSWVRQAPGKGLEWVSSISSDATYTYYADSVKGRFTISRDNAKNVLYLQMTSLRAEDTAVYYCARHPPSYYYAFDYWGQGTTLTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 203 - protein, 572 aa, synthetic construct
  REGION 1..572: note = cMetGShOKT3HholeLALAPA
QVQLVQSGAEVVKPGASVKLSCKASGYTFTSYWLHWVRQAPGQGLEWVGMIDPSNSDTRFNPNFKDRVTITADTSTSTAYMELSSLRSEDTAVYYCATYKSYVSPLDYWGQGTSVTVSSGGSGSQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 204 - protein, 331 aa, synthetic construct
  REGION 1..331: note = cMetGShOKT3L
DIVMTQSPDSLAVSLGERATINCKSSQSLLYTSSQKNYLAWYQQKPGQPPKLLIYWASTRESGVPDRFSGSGSGTDFTLTISSLQAEDVAVYYCQQYYAYPWTFGGGTKLEIKGGSGSDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205 - protein, 575 aa, synthetic construct
  REGION 1..575: note = cMetCl7hOKT3HholeLALAPA
QVQLVQSGAEVVKPGASVKLSCKASGYTFTSYWLHWVRQAPGQGLEWVGMIDPSNSDTRFNPNFKDRVTITADTSTSTAYMELSSLRSEDTAVYYCATYKSYVSPLDYWGQGTSVTVSSGPAGLVSGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 206 - protein, 334 aa, synthetic construct
  REGION 1..334: note = cMetCl7hOKT3L
DIVMTQSPDSLAVSLGERATINCKSSQSLLYTSSQKNYLAWYQQKPGQPPKLLIYWASTRESGVPDRFSGSGSGTDFTLTISSLQAEDVAVYYCQQYYAYPWTFGGGTKLEIKGPAGLVSGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 207 - protein, 575 aa, synthetic construct
  REGION 1..575: note = cMetcl5hOKT3HholeLALAPA
QVQLVQSGAEVVKPGASVKLSCKASGYTFTSYWLHWVRQAPGQGLEWVGMIDPSNSDTRFNPNFKDRVTITADTSTSTAYMELSSLRSEDTAVYYCATYKSYVSPLDYWGQGTSVTVSSASTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 208 - protein, 574 aa, synthetic construct
  REGION 1..574: note = cMetcl8hOKT3HholeLALAPA
QVQLVQSGAEVVKPGASVKLSCKASGYTFTSYWLHWVRQAPGQGLEWVGMIDPSNSDTRFNPNFKDRVTITADTSTSTAYMELSSLRSEDTAVYYCATYKSYVSPLDYWGQGTSVTVSSASTRKAGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 209 - protein, 574 aa, synthetic construct
  REGION 1..574: note = cMetcl9hOKT3HholeLALAPA
QVQLVQSGAEVVKPGASVKLSCKASGYTFTSYWLHWVRQAPGQGLEWVGMIDPSNSDTRFNPNFKDRVTITADTSTSTAYMELSSLRSEDTAVYYCATYKSYVSPLDYWGQGTSVTVSSSTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 210 - protein, 334 aa, synthetic construct
  REGION 1..334: note = cMetcl5hOKT3L
DIVMTQSPDSLAVSLGERATINCKSSQSLLYTSSQKNYLAWYQQKPGQPPKLLIYWASTRESGVPDRFSGSGSGTDFTLTISSLQAEDVAVYYCQQYYAYPWTFGGGTKLEIKASTRKAGGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 211 - protein, 333 aa, synthetic construct
  REGION 1..333: note = cMetcl8hOKT3L
DIVMTQSPDSLAVSLGERATINCKSSQSLLYTSSQKNYLAWYQQKPGQPPKLLIYWASTRESGVPDRFSGSGSGTDFTLTISSLQAEDVAVYYCQQYYAYPWTFGGGTKLEIKASTRKAGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 212 - protein, 333 aa, synthetic construct
  REGION 1..333: note = cMetcl9hOKT3L
DIVMTQSPDSLAVSLGERATINCKSSQSLLYTSSQKNYLAWYQQKPGQPPKLLIYWASTRESGVPDRFSGSGSGTDFTLTISSLQAEDVAVYYCQQYYAYPWTFGGGTKLEIKSTRKAGGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 213 - protein, 721 aa, synthetic construct
  REGION 1..721: note = cMetTgCD28csL1knobLALAPA
DIVMTQSPDSLAVSLGERATINCKSSQSLLYTSSQKNYLAWYQQKPGQPPKLLIYWASTRESGVPDRFSGSGSGTDFTLTISSLQAEDVAVYYCQQYYAYPWTFGGGTKLEIKGGSSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGGGSGGSGSGGGGSASGSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSSGQVQLVQSGAEVVKPGASVKLSCKASGYTFTSYWLHWVRQAPGQGLEWVGMIDPSNSDTRFNPNFKDRVTITADTSTSTAYMELSSLRSEDTAVYYCATYKSYVSPLDYWGQGTSVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 214 - protein, 573 aa, synthetic construct
  REGION 1..573: note = Trop2_317GShOKT3HholeLALAPA
EVQLVESGGGLVKPGGSLRLSCAASGFTFQNYAMSWVRQAPGKGLEWVSSISSDATYTYYADSVKGRFTISRDNAKNVLYLQMTSLRAEDTAVYYCARHPPSYYYAFDYWGQGTTLTVSSGGSGSQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 215 - protein, 222 aa, synthetic construct
  REGION 1..222: note = Trop2_317GShOKT3L
EIVLTQSPATLSLSPGERATLSCRASQSVDSYGNSFLHWYQQKPGQAPRLLIYWASNRATGIPARFSGSGSGTDFTLTISSLEPEDFAVYYCQQNNEDLWTFGGGTKLEIKGGSGSDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIK

SEQ ID NO: 216 - protein, 576 aa, synthetic construct
  REGION 1..576: note = Trop2_317Cl7hOKT3HholeLALAPA
EVQLVESGGGLVKPGGSLRLSCAASGFTFQNYAMSWVRQAPGKGLEWVSSISSDATYTYYADSVKGRFTISRDNAKNVLYLQMTSLRAEDTAVYYCARHPPSYYYAFDYWGQGTTLTVSSGPAGLVSGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 217 - protein, 225 aa, synthetic construct
  REGION 1..225: note = Trop2_317Cl7hOKT3L
EIVLTQSPATLSLSPGERATLSCRASQSVDSYGNSFLHWYQQKPGQAPRLLIYWASNRATGIPARFSGSGSGTDFTLTISSLEPEDFAVYYCQQNNEDLWTFGGGTKLEIKGPAGLVSGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIK

SEQ ID NO: 218 - protein, 576 aa, synthetic construct
  REGION 1..576: note = Trop2_317cl5hOKT3HholeLALAPA
EVQLVESGGGLVKPGGSLRLSCAASGFTFQNYAMSWVRQAPGKGLEWVSSISSDATYTYYADSVKGRFTISRDNAKNVLYLQMTSLRAEDTAVYYCARHPPSYYYAFDYWGQGTTLTVSSASTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 219 - protein, 575 aa, synthetic construct
  REGION 1..575: note = Trop2_317cl8hOKT3HholeLALAPA
EVQLVESGGGLVKPGGSLRLSCAASGFTFQNYAMSWVRQAPGKGLEWVSSISSDATYTYYADSVKGRFTISRDNAKNVLYLQMTSLRAEDTAVYYCARHPPSYYYAFDYWGQGTTLTVSSASTRKAGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 220 - protein, 575 aa, synthetic construct
  REGION 1..575: note = Trop2_317cl9hOKT3HholeLALAPA
EVQLVESGGGLVKPGGSLRLSCAASGFTFQNYAMSWVRQAPGKGLEWVSSISSDATYTYYADSVKGRFTISRDNAKNVLYLQMTSLRAEDTAVYYCARHPPSYYYAFDYWGQGTTLTVSSSTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 221 - protein, 225 aa, synthetic construct
  REGION 1..225: note = Trop2_317cl5hOKT3L
EIVLTQSPATLSLSPGERATLSCRASQSVDSYGNSFLHWYQQKPGQAPRLLIYWASNRATGIPARFSGSGSGTDFTLTISSLEPEDFAVYYCQQNNEDLWTFGGGTKLEIKASTRKAGGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIK

SEQ ID NO: 222 - protein, 224 aa, synthetic construct
  REGION 1..224: note = Trop2_317cl8hOKT3L
EIVLTQSPATLSLSPGERATLSCRASQSVDSYGNSFLHWYQQKPGQAPRLLIYWASNRATGIPARFSGSGSGTDFTLTISSLEPEDFAVYYCQQNNEDLWTFGGGTKLEIKASTRKAGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIK

SEQ ID NO: 223 - protein, 224 aa, synthetic construct
  REGION 1..224: note = Trop2_317cl9hOKT3L
EIVLTQSPATLSLSPGERATLSCRASQSVDSYGNSFLHWYQQKPGQAPRLLIYWASNRATGIPARFSGSGSGTDFTLTISSLEPEDFAVYYCQQNNEDLWTFGGGTKLEIKSTRKAGGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIK

SEQ ID NO: 224 - protein, 713 aa, synthetic construct
  REGION 1..713: note = Trop2_h20TG28csL1KnobLALAPA
DIQMTQSPSSLSASVGDRVTITCQASQDINKYLAWYQKKPGKAPKLLIHYTSNLQTGVPSRFSGSGSGTDFTFTISSLQPEDIATYYCLQYDDLFTFGQGTKLEIKGGSSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGGGSGGSGSGGGGSASGSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSSGQVQLVQSGAEVKKPGASVKVSCKASGSSFTGYTMNWVKQAPGQGLEWIGIINPYQGDTTYNQKFQGKVTITVDKSTSTVYMELSSLRSEDTAVYYCARGAGLYYFDYWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 225 - protein, 713 aa, synthetic construct
  REGION 1..713: note = TG28cs_Trop2_h20L1KnobLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQMTQSPSSLSASVGDRVTITCQASQDINKYLAWYQKKPGKAPKLLIHYTSNLQTGVPSRFSGSGSGTDFTFTISSLQPEDIATYYCLQYDDLFTFGQGTKLEIKGGGGSGGSGSGGGGSASGSGQVQLVQSGAEVKKPGASVKVSCKASGSSFTGYTMNWVKQAPGQGLEWIGIINPYQGDTTYNQKFQGKVTITVDKSTSTVYMELSSLRSEDTAVYYCARGAGLYYFDYWGQGTTVTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 226 - protein, 571 aa, synthetic construct
  REGION 1..571: note = Trop2_h20GShOKT3HoleLALAPA
QVQLVQSGAEVKKPGASVKVSCKASGSSFTGYTMNWVKQAPGQGLEWIGIINPYQGDTTYNQKFQGKVTITVDKSTSTVYMELSSLRSEDTAVYYCARGAGLYYFDYWGQGTTVTVSSGGSGSQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 227 - protein, 324 aa, synthetic construct
  REGION 1..324: note = Trop2_h20GShOKT3L
DIQMTQSPSSLSASVGDRVTITCQASQDINKYLAWYQKKPGKAPKLLIHYTSNLQTGVPSRFSGSGSGTDFTFTISSLQPEDIATYYCLQYDDLFTFGQGTKLEIKGGSGSDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 228 - protein, 574 aa, synthetic construct
  REGION 1..574: note = Trop2_h20Cl7hOKT3HoleLALAPA
QVQLVQSGAEVKKPGASVKVSCKASGSSFTGYTMNWVKQAPGQGLEWIGIINPYQGDTTYNQKFQGKVTITVDKSTSTVYMELSSLRSEDTAVYYCARGAGLYYFDYWGQGTTVTVSSGPAGLVSGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 229 - protein, 327 aa, synthetic construct
  REGION 1..327: note = Trop2_h20Cl7hOKT3L
DIQMTQSPSSLSASVGDRVTITCQASQDINKYLAWYQKKPGKAPKLLIHYTSNLQTGVPSRFSGSGSGTDFTFTISSLQPEDIATYYCLQYDDLFTFGQGTKLEIKGPAGLVSGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 230 - protein, 574 aa, synthetic construct
  REGION 1..574: note = Trop2_h20Cl5hOKT3HoleLALAPA
QVQLVQSGAEVKKPGASVKVSCKASGSSFTGYTMNWVKQAPGQGLEWIGIINPYQGDTTYNQKFQGKVTITVDKSTSTVYMELSSLRSEDTAVYYCARGAGLYYFDYWGQGTTVTVSSASTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 231 - protein, 573 aa, synthetic construct
  REGION 1..573: note = Trop2_h20Cl8hOKT3HoleLALAPA
QVQLVQSGAEVKKPGASVKVSCKASGSSFTGYTMNWVKQAPGQGLEWIGIINPYQGDTTYNQKFQGKVTITVDKSTSTVYMELSSLRSEDTAVYYCARGAGLYYFDYWGQGTTVTVSSASTRKAGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 232 - protein, 573 aa, synthetic construct
  REGION 1..573: note = Trop2_h20Cl9hOKT3HoleLALAPA
QVQLVQSGAEVKKPGASVKVSCKASGSSFTGYTMNWVKQAPGQGLEWIGIINPYQGDTTYNQKFQGKVTITVDKSTSTVYMELSSLRSEDTAVYYCARGAGLYYFDYWGQGTTVTVSSSTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 233 - protein, 327 aa, synthetic construct
  REGION 1..327: note = Trop2_h20Cl5hOKT3L
DIQMTQSPSSLSASVGDRVTITCQASQDINKYLAWYQKKPGKAPKLLIHYTSNLQTGVPSRFSGSGSGTDFTFTISSLQPEDIATYYCLQYDDLFTFGQGTKLEIKASTRKAGGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 234 - protein, 326 aa, synthetic construct
  REGION 1..326: note = Trop2_h20Cl8hOKT3L
DIQMTQSPSSLSASVGDRVTITCQASQDINKYLAWYQKKPGKAPKLLIHYTSNLQTGVPSRFSGSGSGTDFTFTISSLQPEDIATYYCLQYDDLFTFGQGTKLEIKASTRKAGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 235 - protein, 326 aa, synthetic construct
  REGION 1..326: note = Trop2_h20Cl9hOKT3L
DIQMTQSPSSLSASVGDRVTITCQASQDINKYLAWYQKKPGKAPKLLIHYTSNLQTGVPSRFSGSGSGTDFTFTISSLQPEDIATYYCLQYDDLFTFGQGTKLEIKSTRKAGGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 236 - protein, 726 aa, synthetic construct
  REGION 1..726: note = cMetSTARknobLALAPA
DIVMTQSPDSLAVSLGERATINCKSSQSLLYTSSQKNYLAWYQQKPGQPPKLLIYWASTRESGVPDRFSGSGSGTDFTLTISSLQAEDVAVYYCQQYYAYPWTFGGGTKLEIKGGSSGDIVMTQSPDSLAVSLGERATINCKSSQSLLYTSSQKNYLAWYQQKPGQPPKLLIYWASTRESGVPDRFSGSGSGTDFTLTISSLQAEDVAVYYCQQYYAYPWTFGGGTKLEIKGGGGSGGSGSGGGGSASGSGQVQLVQSGAEVVKPGASVKLSCKASGYTFTSYWLHWVRQAPGQGLEWVGMIDPSNSDTRFNPNFKDRVTITADTSTSTAYMELSSLRSEDTAVYYCATYKSYVSPLDYWGQGTSVTVSSGGSSGQVQLVQSGAEVVKPGASVKLSCKASGYTFTSYWLHWVRQAPGQGLEWVGMIDPSNSDTRFNPNFKDRVTITADTSTSTAYMELSSLRSEDTAVYYCATYKSYVSPLDYWGQGTSVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 237 - protein, 724 aa, synthetic construct
  REGION 1..724: note = Trop2_317STARknobLALAPA
EIVLTQSPATLSLSPGERATLSCRASQSVDSYGNSFLHWYQQKPGQAPRLLIYWASNRATGIPARFSGSGSGTDFTLTISSLEPEDFAVYYCQQNNEDLWTFGGGTKLEIKGGSSGEIVLTQSPATLSLSPGERATLSCRASQSVDSYGNSFLHWYQQKPGQAPRLLIYWASNRATGIPARFSGSGSGTDFTLTISSLEPEDFAVYYCQQNNEDLWTFGGGTKLEIKGGGGSGGSGSGGGGSASGSGEVQLVESGGGLVKPGGSLRLSCAASGFTFQNYAMSWVRQAPGKGLEWVSSISSDATYTYYADSVKGRFTISRDNAKNVLYLQMTSLRAEDTAVYYCARHPPSYYYAFDYWGQGTTLTVSSGGSSGEVQLVESGGGLVKPGGSLRLSCAASGFTFQNYAMSWVRQAPGKGLEWVSSISSDATYTYYADSVKGRFTISRDNAKNVLYLQMTSLRAEDTAVYYCARHPPSYYYAFDYWGQGTTLTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 238 - protein, 710 aa, synthetic construct
  REGION 1..710: note = Trop2_20STARknobLALAPA
DIQMTQSPSSLSASVGDRVTITCQASQDINKYLAWYQKKPGKAPKLLIHYTSNLQTGVPSRFSGSGSGTDFTFTISSLQPEDIATYYCLQYDDLFTFGQGTKLEIKGGSSGDIQMTQSPSSLSASVGDRVTITCQASQDINKYLAWYQKKPGKAPKLLIHYTSNLQTGVPSRFSGSGSGTDFTFTISSLQPEDIATYYCLQYDDLFTFGQGTKLEIKGGGGSGGSGSGGGGSASGSGQVQLVQSGAEVKKPGASVKVSCKASGSSFTGYTMNWVKQAPGQGLEWIGIINPYQGDTTYNQKFQGKVTITVDKSTSTVYMELSSLRSEDTAVYYCARGAGLYYFDYWGQGTTVTVSSGGSSGQVQLVQSGAEVKKPGASVKVSCKASGSSFTGYTMNWVKQAPGQGLEWIGIINPYQGDTTYNQKFQGKVTITVDKSTSTVYMELSSLRSEDTAVYYCARGAGLYYFDYWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 239 - protein, 327 aa, synthetic construct
  REGION 1..327: note = hrCD20_sshep12hOKT3L
EIQLTQSPSSLSASVGDRVTITCRASSSVSYIHWFQQKPGSAPKSLIYATSNLASGVPSRFSGSGSGTDYTLTISSLQPEDFATYYCQQWTSNPPTFGCGTKLEIKASTRKAGGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 240 - protein, 577 aa, synthetic construct
  REGION 1..577: note = hrCD20_sscl5hOKT3Hhole
QVQLVQPGAEVKKPGASVKMSCKASGYTFTSYNMHWVRQAPGRCLEWMGAIYPGSGDTSYSQKFQGKVTLTADKSTSTAYMELSSLESEDTAVYYCARSTYYGGDWYFNVWGAGTTVTVSAASTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 241 - protein, 577 aa, synthetic construct
  REGION 1..577: note = hrCD20_sscl5hOKT3HFc
QVQLVQPGAEVKKPGASVKMSCKASGYTFTSYNMHWVRQAPGRCLEWMGAIYPGSGDTSYSQKFQGKVTLTADKSTSTAYMELSSLESEDTAVYYCARSTYYGGDWYFNVWGAGTTVTVSAASTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 242 - protein, 324 aa, synthetic construct
  REGION 1..324: note = hrCD20_GShOKT3L
EIQLTQSPSSLSASVGDRVTITCRASSSVSYIHWFQQKPGSAPKSLIYATSNLASGVPSRFSGSGSGTDYTLTISSLQPEDFATYYCQQWTSNPPTFGGGTKLEIKGGSGSDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 243 - protein, 574 aa, synthetic construct
  REGION 1..574: note = hrCD20_GShOKT3Hhole
QVQLVQPGAEVKKPGASVKMSCKASGYTFTSYNMHWVRQAPGRGLEWMGAIYPGSGDTSYSQKFQGKVTLTADKSTSTAYMELSSLESEDTAVYYCARSTYYGGDWYFNVWGAGTTVTVSAGGSGSQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 244 - protein, 574 aa, synthetic construct
  REGION 1..574: note = hrCD20_GShOKT3HFc
QVQLVQPGAEVKKPGASVKMSCKASGYTFTSYNMHWVRQAPGRGLEWMGAIYPGSGDTSYSQKFQGKVTLTADKSTSTAYMELSSLESEDTAVYYCARSTYYGGDWYFNVWGAGTTVTVSAGGSGSQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 245 - protein, 479 aa, synthetic construct
  REGION 1..479: note = hrCD20scFvFcknob
EIQLTQSPSSLSASVGDRVTITCRASSSVSYIHWFQQKPGSAPKSLIYATSNLASGVPSRFSGSGSGTDYTLTISSLQPEDFATYYCQQWTSNPPTFGGGTKLEIKGGGGSGGSGSGGGGSASGSGQVQLVQPGAEVKKPGASVKMSCKASGYTFTSYNMHWVRQAPGRGLEWMGAIYPGSGDTSYSQKFQGKVTLTADKSTSTAYMELSSLESEDTAVYYCARSTYYGGDWYFNVWGAGTTVTVSAASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 246 - protein, 716 aa, synthetic construct
  REGION 1..716: note = hrCD20scFvFcknob
EIQLTQSPSSLSASVGDRVTITCRASSSVSYIHWFQQKPGSAPKSLIYATSNLASGVPSRFSGSGSGTDYTLTISSLQPEDFATYYCQQWTSNPPTFGGGTKLEIKGGSSGEIQLTQSPSSLSASVGDRVTITCRASSSVSYIHWFQQKPGSAPKSLIYATSNLASGVPSRFSGSGSGTDYTLTISSLQPEDFATYYCQQWTSNPPTFGGGTKLEIKGGGGSGGSGSGGGGSASGSGQVQLVQPGAEVKKPGASVKMSCKASGYTFTSYNMHWVRQAPGRGLEWMGAIYPGSGDTSYSQKFQGKVTLTADKSTSTAYMELSSLESEDTAVYYCARSTYYGGDWYFNVWGAGTTVTVSAGGSSGQVQLVQPGAEVKKPGASVKMSCKASGYTFTSYNMHWVRQAPGRGLEWMGAIYPGSGDTSYSQKFQGKVTLTADKSTSTAYMELSSLESEDTAVYYCARSTYYGGDWYFNVWGAGTTVTVSAASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 247 - protein, 724 aa, synthetic construct
  REGION 1..724: note = hrCD20hCD19Fcknob
EIQLTQSPSSLSASVGDRVTITCRASSSVSYIHWFQQKPGSAPKSLIYATSNLASGVPSRFSGSGSGTDYTLTISSLQPEDFATYYCQQWTSNPPTFGGGTKLEIKGGSSGDIQLTQSPSFLSASVGDRVTITCKASQSVDYSGDSYLNWYQQKPGKAPKLLIYDASNLVSGVPSRFSGSGSGTEFTLTISSLQPEDFATYYCQQSTENPWTFGGGTKLEIKGGGGSGGSGSGGGGSASGSGQVQLVQSGAEVKKPGSSVKVSCKASGYAFSSYWMNWVRQAPGQGLEWMGQIWPGDSDTNYAQKFQGRVTITADESTSTAYMELSSLRSEDTAVYYCARRETTTVGRYYYAMDYWGQGTTVTVSSGGSSGQVQLVQPGAEVKKPGASVKMSCKASGYTFTSYNMHWVRQAPGRGLEWMGAIYPGSGDTSYSQKFQGKVTLTADKSTSTAYMELSSLESEDTAVYYCARSTYYGGDWYFNVWGAGTTVTVSAASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 248 - protein, 724 aa, synthetic construct
  REGION 1..724: note = hCD19hrCD20Fcknob
DIQLTQSPSFLSASVGDRVTITCKASQSVDYSGDSYLNWYQQKPGKAPKLLIYDASNLVSGVPSRFSGSGSGTEFTLTISSLQPEDFATYYCQQSTENPWTFGGGTKLEIKGGSSGEIQLTQSPSSLSASVGDRVTITCRASSSVSYIHWFQQKPGSAPKSLIYATSNLASGVPSRFSGSGSGTDYTLTISSLQPEDFATYYCQQWTSNPPTFGGGTKLEIKGGGGSGGSGSGGGGSASGSGQVQLVQPGAEVKKPGASVKMSCKASGYTFTSYNMHWVRQAPGRGLEWMGAIYPGSGDTSYSQKFQGKVTLTADKSTSTAYMELSSLESEDTAVYYCARSTYYGGDWYFNVWGAGTTVTVSAGGSSGQVQLVQSGAEVKKPGSSVKVSCKASGYAFSSYWMNWVRQAPGQGLEWMGQIWPGDSDTNYAQKFQGRVTITADESTSTAYMELSSLRSEDTAVYYCARRETTTVGRYYYAMDYWGQGTTVTVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 249 - protein, 327 aa, synthetic construct
  REGION 1..327: note = hrCD20_hep12hOKT3L
EIQLTQSPSSLSASVGDRVTITCRASSSVSYIHWFQQKPGSAPKSLIYATSNLASGVPSRFSGSGSGTDYTLTISSLQPEDFATYYCQQWTSNPPTFGGGTKLEIKASTRKAGGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 250 - protein, 324 aa, synthetic construct
  REGION 1..324: note = hrCD20_ssGShOKT3L
EIQLTQSPSSLSASVGDRVTITCRASSSVSYIHWFQQKPGSAPKSLIYATSNLASGVPSRFSGSGSGTDYTLTISSLQPEDFATYYCQQWTSNPPTFGCGTKLEIKGGSGSDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 251 - protein, 577 aa, synthetic construct
  REGION 1..577: note = hrCD20_cl5hOKT3Hhole
QVQLVQPGAEVKKPGASVKMSCKASGYTFTSYNMHWVRQAPGRGLEWMGAIYPGNGDTSYNQKFQGRVTLTADKSTSTAYMELSSLESEDTAVYYCARSTYYGGDWYFNVWGAGTTVTVSAASTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 252 - protein, 577 aa, synthetic construct
  REGION 1..577: note = hrCD20_cl5hOKT3HholeLALAPA
QVQLVQPGAEVKKPGASVKMSCKASGYTFTSYNMHWVRQAPGRGLEWMGAIYPGNGDTSYNQKFQGRVTLTADKSTSTAYMELSSLESEDTAVYYCARSTYYGGDWYFNVWGAGTTVTVSAASTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 253 - protein, 577 aa, synthetic construct
  REGION 1..577: note = hrCD20_sscl5hOKT3Hhole
QVQLVQPGAEVKKPGASVKMSCKASGYTFTSYNMHWVRQAPGRCLEWMGAIYPGNGDTSYNQKFQGRVTLTADKSTSTAYMELSSLESEDTAVYYCARSTYYGGDWYFNVWGAGTTVTVSAASTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 254 - protein, 577 aa, synthetic construct
  REGION 1..577: note = hrCD20_sscl5hOKT3HholeLALAPA
QVQLVQPGAEVKKPGASVKMSCKASGYTFTSYNMHWVRQAPGRCLEWMGAIYPGNGDTSYNQKFQGRVTLTADKSTSTAYMELSSLESEDTAVYYCARSTYYGGDWYFNVWGAGTTVTVSAASTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 255 - protein, 574 aa, synthetic construct
  REGION 1..574: note = hrCD20_GShOKT3Hhole
QVQLVQPGAEVKKPGASVKMSCKASGYTFTSYNMHWVRQAPGRGLEWMGAIYPGNGDTSYNQKFQGRVTLTADKSTSTAYMELSSLESEDTAVYYCARSTYYGGDWYFNVWGAGTTVTVSAGGSGSQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 256 - protein, 574 aa, synthetic construct
  REGION 1..574: note = hrCD20_GShOKT3HholeLALAPA
QVQLVQPGAEVKKPGASVKMSCKASGYTFTSYNMHWVRQAPGRGLEWMGAIYPGNGDTSYNQKFQGRVTLTADKSTSTAYMELSSLESEDTAVYYCARSTYYGGDWYFNVWGAGTTVTVSAGGSGSQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 257 - protein, 332 aa, synthetic construct
  REGION 1..332: note = hrCD19_sshep12hOKT3L
DIQLTQSPSFLSASVGDRVTITCKASQSVDYSGDSYLNWYQQKPGKAPKLLIYDASNLVSGVPSRFSGSGSGTEFTLTISSLQPEDFATYYCQQSTENPWTFGCGTKLEIKASTRKAGGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 258 - protein, 332 aa, synthetic construct
  REGION 1..332: note = hrCD19_hep12hOKT3L
DIQLTQSPSFLSASVGDRVTITCKASQSVDYSGDSYLNWYQQKPGKAPKLLIYDASNLVSGVPSRFSGSGSGTEFTLTISSLQPEDFATYYCQQSTENPWTFGGGTKLEIKASTRKAGGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 259 - protein, 580 aa, synthetic construct
  REGION 1..580: note = hrCD19_cl5hOKT3Hhole
QVQLVQSGAEVKKPGSSVKVSCKASGYAFSSYWMNWVRQAPGQGLEWMGQIWPGDSDTNYAQKFQGRVTITADESTSTAYMELSSLRSEDTAVYYCARRETTTVGRYYYAMDYWGQGTTVTVSSASTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 260 - protein, 580 aa, synthetic construct
  REGION 1..580: note = hrCD19_cl5hOKT3HholeLALAPA
QVQLVQSGAEVKKPGSSVKVSCKASGYAFSSYWMNWVRQAPGQGLEWMGQIWPGDSDTNYAQKFQGRVTITADESTSTAYMELSSLRSEDTAVYYCARRETTTVGRYYYAMDYWGQGTTVTVSSASTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 261 - protein, 580 aa, synthetic construct
  REGION 1..580: note = hrCD19_sscl5hOKT3Hhole
QVQLVQSGAEVKKPGSSVKVSCKASGYAFSSYWMNWVRQAPGQCLEWMGQIWPGDSDTNYAQKFQGRVTITADESTSTAYMELSSLRSEDTAVYYCARRETTTVGRYYYAMDYWGQGTTVTVSSASTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 262 - protein, 580 aa, synthetic construct
  REGION 1..580: note = hrCD19_sscl5hOKT3HholeLALAPA
QVQLVQSGAEVKKPGSSVKVSCKASGYAFSSYWMNWVRQAPGQCLEWMGQIWPGDSDTNYAQKFQGRVTITADESTSTAYMELSSLRSEDTAVYYCARRETTTVGRYYYAMDYWGQGTTVTVSSASTRKAGGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 263 - protein, 329 aa, synthetic construct
  REGION 1..329: note = hrCD19_GShOKT3L
DIQLTQSPSFLSASVGDRVTITCKASQSVDYSGDSYLNWYQQKPGKAPKLLIYDASNLVSGVPSRFSGSGSGTEFTLTISSLQPEDFATYYCQQSTENPWTFGGGTKLEIKGGSGSDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 264 - protein, 329 aa, synthetic construct
  REGION 1..329: note = hrCD19ss_GShOKT3L
DIQLTQSPSFLSASVGDRVTITCKASQSVDYSGDSYLNWYQQKPGKAPKLLIYDASNLVSGVPSRFSGSGSGTEFTLTISSLQPEDFATYYCQQSTENPWTFGCGTKLEIKGGSGSDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 265 - protein, 577 aa, synthetic construct
  REGION 1..577: note = hrCD19_GShOKT3Hhole
QVQLVQSGAEVKKPGSSVKVSCKASGYAFSSYWMNWVRQAPGQGLEWMGQIWPGDSDTNYAQKFQGRVTITADESTSTAYMELSSLRSEDTAVYYCARRETTTVGRYYYAMDYWGQGTTVTVSSGGSGSQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 266 - protein, 577 aa, synthetic construct
  REGION 1..577: note = hrCD19_GShOKT3HholeLALAPA
QVQLVQSGAEVKKPGSSVKVSCKASGYAFSSYWMNWVRQAPGQGLEWMGQIWPGDSDTNYAQKFQGRVTITADESTSTAYMELSSLRSEDTAVYYCARRETTTVGRYYYAMDYWGQGTTVTVSSGGSGSQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 267 - protein, 724 aa, synthetic construct
  REGION 1..724: note = hrCD19TgCD28csL1knobLALAPA
DIQLTQSPSFLSASVGDRVTITCKASQSVDYSGDSYLNWYQQKPGKAPKLLIYDASNLVSGVPSRFSGSGSGTEFTLTISSLQPEDFATYYCQQSTENPWTFGGGTKLEIKGGSSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGGGSGGSGSGGGGSASGSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSSGQVQLVQSGAEVKKPGSSVKVSCKASGYAFSSYWMNWVRQAPGQGLEWMGQIWPGDSDTNYAQKFQGRVTITADESTSTAYMELSSLRSEDTAVYYCARRETTTVGRYYYAMDYWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 268 - protein, 724 aa, synthetic construct
  REGION 1..724: note = hrCD19TgCD28csL1knob
DIQLTQSPSFLSASVGDRVTITCKASQSVDYSGDSYLNWYQQKPGKAPKLLIYDASNLVSGVPSRFSGSGSGTEFTLTISSLQPEDFATYYCQQSTENPWTFGGGTKLEIKGGSSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGGGSGGSGSGGGGSASGSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSSGQVQLVQSGAEVKKPGSSVKVSCKASGYAFSSYWMNWVRQAPGQGLEWMGQIWPGDSDTNYAQKFQGRVTITADESTSTAYMELSSLRSEDTAVYYCARRETTTVGRYYYAMDYWGQGTTVTVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 269 - protein, 724 aa, synthetic construct
  REGION 1..724: note = TgCD28cshrCD19L1knobLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPSFLSASVGDRVTITCKASQSVDYSGDSYLNWYQQKPGKAPKLLIYDASNLVSGVPSRFSGSGSGTEFTLTISSLQPEDFATYYCQQSTENPWTFGGGTKLEIKGGGGSGGSGSGGGGSASGSGQVQLVQSGAEVKKPGSSVKVSCKASGYAFSSYWMNWVRQAPGQGLEWMGQIWPGDSDTNYAQKFQGRVTITADESTSTAYMELSSLRSEDTAVYYCARRETTTVGRYYYAMDYWGQGTTVTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 270 - protein, 647 aa, synthetic construct
  REGION 1..647: note = TgCD28cshrCD19L1knob
LQPEDFATYYCQQGQTYPYTFGGGTKVEIKGGSSGDIQLTQSPSFLSASVGDRVTITCKASQSVDYSGDSYLNWYQQKPGKAPKLLIYDASNLVSGVPSRFSGSGSGTEFTLTISSLQPEDFATYYCQQSTENPWTFGGGTKLEIKGGGGSGGSGSGGGGSASGSGQVQLVQSGAEVKKPGSSVKVSCKASGYAFSSYWMNWVRQAPGQGLEWMGQIWPGDSDTNYAQKFQGRVTITADESTSTAYMELSSLRSEDTAVYYCARRETTTVGRYYYAMDYWGQGTTVTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 271 - protein, 716 aa, synthetic construct
  REGION 1..716: note = TgCD28cshrCD20L1knobLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGEIQLTQSPSSLSASVGDRVTITCRASSSVSYIHWFQQKPGSAPKSLIYATSNLASGVPSRFSGSGSGTDYTLTISSLQPEDFATYYCQQWTSNPPTFGGGTKLEIKGGGGSGGSGSGGGGSASGSGQVQLVQPGAEVKKPGASVKMSCKASGYTFTSYNMHWVRQAPGRGLEWMGAIYPGNGDTSYNQKFQGRVTLTADKSTSTAYMELSSLESEDTAVYYCARSTYYGGDWYFNVWGAGTTVTVSAGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 272 - protein, 716 aa, synthetic construct; identical to SEQ ID NO: 271
  REGION 1..716: note = TgCD28cshrCD20L1knob

SEQ ID NO: 273 - protein, 714 aa, synthetic construct
  REGION 1..714: note = ahCD28xahCD3 L1 Hcc hIgG1LALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKGGGGSGGSGSGGGGSASGSGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 274 - DNA, 2142 bp, synthetic construct
  misc_feature 1..2142: note = ahCD28xahCD3 L1 Hcc hIgG1LALAPA
  source 1..2142: mol_type = other DNA
gacatccagatgacacagagccctagcagcctgtctgccagcgtgggagacagagtgaccatcacatgtcacgccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacttcgccacctactattgtcagcagggccagacatacccctacacctttggcggcggaacaaaggtggaaatcaagggcggaagcagcggcgacatccagctgacacagagcccttctagcctgtctgccagcgtgggcgacagagtgaccatcacatgtagagccagccagagcatcagctacctgaactggtatcagcagaagcccggcaagagccccaagcggtggatctacgatacaagcaagctggcctctggcgtgcccagcagattttctggctctggcagcggcaccgactacaccctgacaatcagcagcatgcagcctgaggatgccgccacctactactgccagcagtggtccagcaatcccctgacatttggcggaggcaccaaggtggaaatcaagggtggcggaggaagcggcggatcaggatctggcggcggaggatctgctagcggatctggacaggttcagctggttcagtctggcgccgaagtggctaaacctggcgcctccgtgaaggtgtcctgtaaagccagcggctacacattcacccggtacaccatgcactgggtcaagcaggctccaggacaaggcttggagtggatcggctacatcaaccctagccggggctacaccaattacgcccagaagttccagggcaaggccacactgaccaccgacaagagcacaagcaccgcctacatggaactgagcagcctgagaagcgaggacaccgccgtgtactactgtgcccggtactacgacgaccactacagcctggattattggggccagggcacaaccctgaccgtgtcatctggtggatctagtggccaggttcagctggttcagtctggcgccgaagtgaagaaacctggcgcctctgtgaaggtgtcctgcaaggccagcggctacacctttaccagctactacatccactgggtccgacaggcccctggacaaggactggaatggatcggcagcatctaccccggcaacgtgaacaccaactacaacgagaagttcaaggaccgggccacactgaccgtggacacctctatcagcaccgcctacatggaactgagccggctgagatccgatgataccgccgtgtacttctgcaccagaagccactacggcctggactggaacttcgatgtgtggggccagggcaccaccgtgacagtttcttctgcttctggaggctccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 275 - protein, 714 aa, synthetic construct
  REGION 1..714: note = ahCD3xahCD28 L1 Hcc hIgG1LALAPA
DIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKGGSSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGGGSGGSGSGGGGSASGSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSSGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 276 - DNA, 2142 bp, synthetic construct
  misc_feature 1..2142: note = ahCD3xahCD28 L1 Hcc hIgG1LALAPA
  source 1..2142: mol_type = other DNA
gacatccagctgacacagagcccttctagcctgtctgccagcgtgggcgacagagtgaccatcacatgtagagccagccagagcatcagctacctgaactggtatcagcagaagcccggcaagagccccaagcggtggatctacgatacaagcaagctggcctctggcgtgcccagcagattttctggctctggcagcggcaccgactacaccctgacaatcagcagcatgcagcctgaggatgccgccacctactactgccagcagtggtccagcaatcccctgacatttggcggaggcaccaaggtggaaatcaagggcggaagcagcggcgacatccagatgacacagagccctagcagcctgtctgccagcgtgggagacagagtgaccatcacatgtcacgccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacttcgccacctactattgtcagcagggccagacatacccctacacctttggcggcggaacaaaggtggaaatcaagggtggcggaggaagcggcggatcaggatctggcggcggaggatctgctagcggatctggacaggttcagctggttcagtctggcgccgaagtgaagaaacctggcgcctctgtgaaggtgtcctgcaaggccagcggctacacctttaccagctactacatccactgggtccgacaggcccctggacaaggactggaatggatcggcagcatctaccccggcaacgtgaacaccaactacaacgagaagttcaaggaccgggccacactgaccgtggacacctctatcagcaccgcctacatggaactgagccggctgagatccgatgataccgccgtgtacttctgcaccagaagccactacggcctggactggaacttcgatgtgtggggccagggcaccaccgtgacagtttcttctggtggatctagtggccaggttcagctggttcagtctggcgccgaagtggctaaacctggcgcctccgtgaaggtgtcctgtaaagccagcggctacacattcacccggtacaccatgcactgggtcaagcaggctccaggacaaggcttggagtggatcggctacatcaaccctagccggggctacaccaattacgcccagaagttccagggcaaggccacactgaccaccgacaagagcacaagcaccgcctacatggaactgagcagcctgagaagcgaggacaccgccgtgtactactgtgcccggtactacgacgaccactacagcctggattattggggccagggcacaaccctgaccgtgtcatctgcttctggaggctccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 277 - protein, 448 aa, synthetic construct
  REGION 1..448: note = ahCD3_Hrw11_Hcc_LALAPA
QVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 278 - DNA, 1344 bp, synthetic construct
  misc_feature 1..1344: note = ahCD3_Hrw11_Hcc_LALAPA
  source 1..1344: mol_type = other DNA
caggttcagctggttcagtctggcgccgaagtggctaaacctggcgcctccgtgaaggtgtcctgtaaagccagcggctacacattcacccggtacaccatgcactgggtcaagcaggctccaggacaaggcttggagtggatcggctacatcaaccctagccggggctacaccaattacgcccagaagttccagggcaaggccacactgaccaccgacaagagcacaagcaccgcctacatggaactgagcagcctgagaagcgaggacaccgccgtgtactactgtgcccggtactacgacgaccactacagcctggattattggggccagggcacaaccctgaccgtgtcatctgcttcgaccaagggcccatccgtgtttcctctggctcccagcagcaagtctacaagcggaggaacagccgctctgggctgcctggtcaaggattactttcccgagcctgtgaccgtgtcctggaattctggcgctctgacaagcggcgtgcacacctttccagctgtgctgcaaagcagcggcctgtactctctgagcagcgtggtcacagtgcctagctctagcctgggcacccagacctacatctgcaatgtgaaccacaagcctagcaacaccaaggtggacaagaaggtggaacccaagagctgcgataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 279 - protein, 226 aa, synthetic construct
  REGION 1..226: note = hu IgG1 Fc_Kcc_LALAPA
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 280 - DNA, 678 bp, synthetic construct
  misc_feature 1..678: note = hu IgG1 Fc_Kcc_LALAPA
  source 1..678: mol_type = other DNA
gataagacccacacatgtcctccatgtcctgctccagaagctgctggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggaaccccaggtttacacccttcctccatgccgggatgagctgaccaagaaccaggtgtccctgtggtgtctcgtgaagggcttctaccccagcgacattgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctgga

SEQ ID NO: 281 - protein, 893 aa, synthetic construct
  REGION 1..893: note = ahCD3_Hrw8_Hcc_hOX40L LALAPA
QVQLVQSGAEVAKPGASVKVSCKASGYTFTRYTMHWVRQAPGQGLEWIGYINPSRGYTNYAQKFQGRATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGSSGSGSGGSGSSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGSGGSGGGSSGSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGSGGSGGGSSGSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 282 - DNA, 2679 bp, synthetic construct
  misc_feature 1..2679: note = ahCD3_Hrw8_Hcc_hOX40L LALAPA
  source 1..2679: mol_type = other DNA
caggttcagctggttcagtctggcgccgaagtggctaaacctggcgcctccgtgaaggtgtcctgtaaagccagcggctacacattcacccggtacaccatgcactgggtccgacaggctccaggacaaggcttggagtggatcggctacatcaaccccagccggggctacaccaattacgcccagaagttccagggcagagccacactgaccaccgacaagagcacaagcaccgcctacatggaactgagcagcctgagaagcgaggacaccgccgtgtactactgtgcccggtactacgacgaccactacagcctggattattggggccagggcacaaccctgaccgtgtcatctgcttcgaccaagggcccatccgtgtttcctctggctcccagcagcaagtctacaagcggaggaacagccgctctgggctgcctggtcaaggattactttcccgagcctgtgaccgtgtcctggaattctggcgctctgacaagcggcgtgcacacctttccagctgtgctgcaaagcagcggcctgtactctctgagcagcgtggtcacagtgcctagctctagcctgggcacccagacctacatctgcaatgtgaaccacaagcctagcaacaccaaggtggacaagaaggtggaacccaagagctgcgctagcggaggctccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggcggaggatcctctggatctggaagcggcggctctggctctagcggagtgtctcacagatacagcagaatccagagcatcaaggtgcagttcaccgagtacaagaaagagaagggcttcatcctgaccagccagaaagaggacgagatcatgaaggtgcagaacaacagcgtgatcatcaactgcgacggcttctacctgatcagcctgaagggctacttcagccaagaagtgaacatcagcctgcactaccagaaggacgaggaacccctgttccagctgaagaaagtgcggagcgtgaacagcctgatggtggccagcctgacctacaaggacaaggtgtacctgaacgtgaccaccgacaacaccagcctggacgacttccatgtgaatggcggcgagctgatcctgatccatcagaaccctggcgagttctgcgtgctcggaggatctggtggatctggcggtggaagttctggtagcggcgtgtcccatcggtacagccggattcagtccattaaggtccagtttacagagtataagaaagaaaaaggattcattctcacctctcagaaagaagatgagattatgaaggtccaaaacaattccgtcatcatcaattgtgacgggttttatctcatctccctcaagggctatttctctcaagaagtcaatatctcactccactatcagaaagatgaagaaccgctctttcagctcaaaaaagttcgctccgtgaactctctgatggtcgcctctctgacgtataaggacaaagtctatctcaatgtcacgacggacaacacatccctcgacgatttccacgtcaacggcggagaactgattctcattcaccagaatcctggggagttttgtgtcctcggcggaagtggtggaagcggaggcggaagttcaggctctggcgtcagccaccgctactccaggattcaatccatcaaagttcaattcacagagtacaaaaaagaaaaaggttttatcctgacgtcccaaaaagaggacgaaattatgaaggttcaaaacaactctgtgatcattaactgtgacggtttttacttgatctctctgaagggatacttttcccaagaagtcaacatttccctgcattatcaaaaggatgaggaaccacttttccaattgaaaaaagttcggagcgtcaactcactcatggtggcttccctgacgtacaaagataaggtttacttgaatgtcaccacagataatacgagcctcgatgactttcatgttaacggtggcgaactcatactgatccaccaaaatccaggcgaattctgtgtgctg

SEQ ID NO: 283 - protein, 893 aa, synthetic construct
  REGION 1..893: note = ahCD3_HRw11_Hcc_hOX40L LALAPA
QVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGSSGSGSGGSGSSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGSGGSGGGSSGSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGSGGSGGGSSGSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 284 - DNA, 2679 bp, synthetic construct
  misc_feature 1..2679: note = ahCD3_HRw11_Hcc_hOX40L LALAPA
  source 1..2679: mol_type = other DNA
caggttcagctggttcagtctggcgccgaagtggctaaacctggcgcctccgtgaaggtgtcctgtaaagccagcggctacacattcacccggtacaccatgcactgggtcaagcaggctccaggacaaggcttggagtggatcggctacatcaaccctagccggggctacaccaattacgcccagaagttccagggcaaggccacactgaccaccgacaagagcacaagcaccgcctacatggaactgagcagcctgagaagcgaggacaccgccgtgtactactgtgcccggtactacgacgaccactacagcctggattattggggccagggcacaaccctgaccgtgtcatctgcttcgaccaagggcccatccgtgtttcctctggctcccagcagcaagtctacaagcggaggaacagccgctctgggctgcctggtcaaggattactttcccgagcctgtgaccgtgtcctggaattctggcgctctgacaagcggcgtgcacacctttccagctgtgctgcaaagcagcggcctgtactctctgagcagcgtggtcacagtgcctagctctagcctgggcacccagacctacatctgcaatgtgaaccacaagcctagcaacaccaaggtggacaagaaggtggaacccaagagctgcgctagcggaggctccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggcggaggatcctctggatctggaagcggcggctctggctctagcggagtgtctcacagatacagcagaatccagagcatcaaggtgcagttcaccgagtacaagaaagagaagggcttcatcctgaccagccagaaagaggacgagatcatgaaggtgcagaacaacagcgtgatcatcaactgcgacggcttctacctgatcagcctgaagggctacttcagccaagaagtgaacatcagcctgcactaccagaaggacgaggaacccctgttccagctgaagaaagtgcggagcgtgaacagcctgatggtggccagcctgacctacaaggacaaggtgtacctgaacgtgaccaccgacaacaccagcctggacgacttccatgtgaatggcggcgagctgatcctgatccatcagaaccctggcgagttctgcgtgctcggaggatctggtggatctggcggtggaagttctggtagcggcgtgtcccatcggtacagccggattcagtccattaaggtccagtttacagagtataagaaagaaaaaggattcattctcacctctcagaaagaagatgagattatgaaggtccaaaacaattccgtcatcatcaattgtgacgggttttatctcatctccctcaagggctatttctctcaagaagtcaatatctcactccactatcagaaagatgaagaaccgctctttcagctcaaaaaagttcgctccgtgaactctctgatggtcgcctctctgacgtataaggacaaagtctatctcaatgtcacgacggacaacacatccctcgacgatttccacgtcaacggcggagaactgattctcattcaccagaatcctggggagttttgtgtcctcggcggaagtggtggaagcggaggcggaagttcaggctctggcgtcagccaccgctactccaggattcaatccatcaaagttcaattcacagagtacaaaaaagaaaaaggttttatcctgacgtcccaaaaagaggacgaaattatgaaggttcaaaacaactctgtgatcattaactgtgacggtttttacttgatctctctgaagggatacttttcccaagaagtcaacatttccctgcattatcaaaaggatgaggaaccacttttccaattgaaaaaagttcggagcgtcaactcactcatggtggcttccctgacgtacaaagataaggtttacttgaatgtcaccacagataatacgagcctcgatgactttcatgttaacggtggcgaactcatactgatccaccaaaatccaggcgaattctgtgtgctg

SEQ ID NO: 285 - protein, 665 aa, synthetic construct
  REGION 1..665: note = hu IgG1 Fc stump_Kcc_hOX40L LALAPA
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSGSGSGGSGSSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGSGGSGGGSSGSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGSGGSGGGSSGSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 286 - DNA, 1995 bp, synthetic construct
  misc_feature 1..1995: note = hu IgG1 Fc stump_Kcc_hOX40L LALAPA
  source 1..1995: mol_type = other DNA
gataagacccacacatgtcctccatgtcctgctccagaagctgctggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggaaccccaggtttacacccttcctccatgccgggatgagctgaccaagaaccaggtgtccctgtggtgtctggtcaagggcttctaccccagcgacattgccgtggaatgggagagcaatggccagcctgagaacaactacaagaccacacctcctgtgctggactccgacggatcattcttcctgtacagcaagctgactgtggacaagagcagatggcagcagggcaacgtgttcagctgcagcgtgatgcacgaggccctgcacaaccactacacacagaagtccctgtctctgagccctggcggaggatcctctggatctggaagcggcggctctggctctagcggagtgtctcacagatacagcagaatccagagcatcaaggtgcagttcaccgagtacaagaaagagaagggcttcatcctgaccagccagaaagaggacgagatcatgaaggtgcagaacaacagcgtgatcatcaactgcgacggcttctacctgatcagcctgaagggctacttcagccaagaagtgaacatcagcctgcactaccagaaggacgaggaacccctgttccagctgaagaaagtgcggagcgtgaacagcctgatggtggccagcctgacctacaaggacaaggtgtacctgaacgtgaccaccgacaacaccagcctggacgacttccatgtgaatggcggcgagctgatcctgatccatcagaaccctggcgagttctgcgtgctcggaggatctggtggatctggcggtggaagttctggtagcggcgtgtcccatcggtacagccggattcagtccattaaggtccagtttacagagtataagaaagaaaaaggattcattctcacctctcagaaagaagatgagattatgaaggtccaaaacaattccgtcatcatcaattgtgacgggttttatctcatctccctcaagggctatttctctcaagaagtcaatatctcactccactatcagaaagatgaagaaccgctctttcagctcaaaaaagttcgctccgtgaactctctgatggtcgcctctctgacgtataaggacaaagtctatctcaatgtcacgacggacaacacatccctcgacgatttccacgtcaacggcggagaactgattctcattcaccagaatcctggggagttttgtgtcctcggcggaagtggtggaagcggaggcggaagttcaggctctggcgtcagccaccgctactccaggattcaatccatcaaagttcaattcacagagtacaaaaaagaaaaaggttttatcctgacgtcccaaaaagaggacgaaattatgaaggttcaaaacaactctgtgatcattaactgtgacggtttttacttgatctctctgaagggatacttttcccaagaagtcaacatttccctgcattatcaaaaggatgaggaaccacttttccaattgaaaaaagttcggagcgtcaactcactcatggtggcttccctgacgtacaaagataaggtttacttgaatgtcaccacagataatacgagcctcgatgactttcatgttaacggtggcgaactcatactgatccaccaaaatccaggcgaattctgtgtgctg

SEQ ID NO: 287 - protein, 714 aa, synthetic construct
  REGION 1..714: note = ahCD28xahCD3 L1 hIgG1LALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKGGGGSGGSGSGGGGSASGSGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 288 - DNA, 2142 bp, synthetic construct
  misc_feature 1..2142: note = ahCD28xahCD3 L1 hIgG1LALAPA
  source 1..2142: mol_type = other DNA
gacatccagatgacacagagccctagcagcctgtctgccagcgtgggagacagagtgaccatcacatgtcacgccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacttcgccacctactattgtcagcagggccagacatacccctacacctttggcggcggaacaaaggtggaaatcaagggcggaagcagcggcgacatccagctgacacagagcccttctagcctgtctgccagcgtgggcgacagagtgaccatcacatgtagagccagccagagcatcagctacctgaactggtatcagcagaagcccggcaagagccccaagcggtggatctacgatacaagcaagctggcctctggcgtgcccagcagattttctggctctggcagcggcaccgactacaccctgacaatcagcagcatgcagcctgaggatgccgccacctactactgccagcagtggtccagcaatcccctgacatttggcggaggcaccaaggtggaaatcaagggtggcggaggaagcggcggatcaggatctggcggcggaggatctgctagcggatctggacaggttcagctggttcagtctggcgccgaagtggctaaacctggcgcctccgtgaaggtgtcctgtaaagccagcggctacacattcacccggtacaccatgcactgggtcaagcaggctccaggacaaggcttggagtggatcggctacatcaaccctagccggggctacaccaattacgcccagaagttccagggcaaggccacactgaccaccgacaagagcacaagcaccgcctacatggaactgagcagcctgagaagcgaggacaccgccgtgtactactgtgcccggtactacgacgaccactacagcctggattattggggccagggcacaaccctgaccgtgtcatctggtggatctagtggccaggttcagctggttcagtctggcgccgaagtgaagaaacctggcgcctctgtgaaggtgtcctgcaaggccagcggctacacctttaccagctactacatccactgggtccgacaggcccctggacaaggactggaatggatcggcagcatctaccccggcaacgtgaacaccaactacaacgagaagttcaaggaccgggccacactgaccgtggacacctctatcagcaccgcctacatggaactgagccggctgagatccgatgataccgccgtgtacttctgcaccagaagccactacggcctggactggaacttcgatgtgtggggccagggcaccaccgtgacagtttcttctgcttctggaggctccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggaaccccaggtttacacactgcctccaagcagggacgagctgaccaagaatcaggtgtccctgacctgcctcgtgaagggcttttaccccagcgacattgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctgga

SEQ ID NO: 289 - protein, 1153 aa, synthetic construct
  REGION 1..1153: note = ahCD28xCD3_Hcc_hOX40L LALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKGGGGSGGSGSGGGGSASGSGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGSSGSGSGGSGSSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGSGGSGGGSSGSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGSGGSGGGSSGSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 290 - DNA, 3459 bp, synthetic construct
  misc_feature 1..3459: note = ahCD28xCD3_Hcc_hOX40L LALAPA
  source 1..3459: mol_type = other DNA
gacatccagatgacacagagccctagcagcctgtctgccagcgtgggagacagagtgaccatcacatgtcacgccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacttcgccacctactattgtcagcagggccagacatacccctacacctttggcggcggaacaaaggtggaaatcaagggcggaagcagcggcgacatccagctgacacagagcccttctagcctgtctgccagcgtgggcgacagagtgaccatcacatgtagagccagccagagcatcagctacctgaactggtatcagcagaagcccggcaagagccccaagcggtggatctacgatacaagcaagctggcctctggcgtgcccagcagattttctggctctggcagcggcaccgactacaccctgacaatcagcagcatgcagcctgaggatgccgccacctactactgccagcagtggtccagcaatcccctgacatttggcggaggcaccaaggtggaaatcaagggtggcggaggaagcggcggatcaggatctggcggcggaggatctgctagcggatctggacaggttcagctggttcagtctggcgccgaagtggctaaacctggcgcctccgtgaaggtgtcctgtaaagccagcggctacacattcacccggtacaccatgcactgggtcaagcaggctccaggacaaggcttggagtggatcggctacatcaaccctagccggggctacaccaattacgcccagaagttccagggcaaggccacactgaccaccgacaagagcacaagcaccgcctacatggaactgagcagcctgagaagcgaggacaccgccgtgtactactgtgcccggtactacgacgaccactacagcctggattattggggccagggcacaaccctgaccgtgtcatctggtggatctagtggccaggttcagctggttcagtctggcgccgaagtgaagaaacctggcgcctctgtgaaggtgtcctgcaaggccagcggctacacctttaccagctactacatccactgggtccgacaggcccctggacaaggactggaatggatcggcagcatctaccccggcaacgtgaacaccaactacaacgagaagttcaaggaccgggccacactgaccgtggacacctctatcagcaccgcctacatggaactgagccggctgagatccgatgataccgccgtgtacttctgcaccagaagccactacggcctggactggaacttcgatgtgtggggccagggcaccaccgtgacagtttcttctgcttctggaggctccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggcggaggatcctctggatctggaagcggcggctctggctctagcggagtgtctcacagatacagcagaatccagagcatcaaggtgcagttcaccgagtacaagaaagagaagggcttcatcctgaccagccagaaagaggacgagatcatgaaggtgcagaacaacagcgtgatcatcaactgcgacggcttctacctgatcagcctgaagggctacttcagccaagaagtgaacatcagcctgcactaccagaaggacgaggaacccctgttccagctgaagaaagtgcggagcgtgaacagcctgatggtggccagcctgacctacaaggacaaggtgtacctgaacgtgaccaccgacaacaccagcctggacgacttccatgtgaatggcggcgagctgatcctgatccatcagaaccctggcgagttctgcgtgctcggaggatctggtggatctggcggtggaagttctggtagcggcgtgtcccatcggtacagccggattcagtccattaaggtccagtttacagagtataagaaagaaaaaggattcattctcacctctcagaaagaagatgagattatgaaggtccaaaacaattccgtcatcatcaattgtgacgggttttatctcatctccctcaagggctatttctctcaagaagtcaatatctcactccactatcagaaagatgaagaaccgctctttcagctcaaaaaagttcgctccgtgaactctctgatggtcgcctctctgacgtataaggacaaagtctatctcaatgtcacgacggacaacacatccctcgacgatttccacgtcaacggcggagaactgattctcattcaccagaatcctggggagttttgtgtcctcggcggaagtggtggaagcggaggcggaagttcaggctctggcgtcagccaccgctactccaggattcaatccatcaaagttcaattcacagagtacaaaaaagaaaaaggttttatcctgacgtcccaaaaagaggacgaaattatgaaggttcaaaacaactctgtgatcattaactgtgacggtttttacttgatctctctgaagggatacttttcccaagaagtcaacatttccctgcattatcaaaaggatgaggaaccacttttccaattgaaaaaagttcggagcgtcaactcactcatggtggcttccctgacgtacaaagataaggtttacttgaatgtcaccacagataatacgagcctcgatgactttcatgttaacggtggcgaactcatactgatccaccaaaatccaggcgaattctgtgtgctg

SEQ ID NO: 291 - protein, 1153 aa, synthetic construct
  REGION 1..1153: note = CD3xCD28_Hcc_hOX40L LALAPA
DIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKGGSSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGGGSGGSGSGGGGSASGSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSSGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGSSGSGSGGSGSSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGSGGSGGGSSGSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGSGGSGGGSSGSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 292 - DNA, 3459 bp, synthetic construct
  misc_feature 1..3459: note = CD3xCD28_Hcc_hOX40L LALAPA
  source 1..3459: mol_type = other DNA
gacatccagctgacacagagcccttctagcctgtctgccagcgtgggcgacagagtgaccatcacatgtagagccagccagagcatcagctacctgaactggtatcagcagaagcccggcaagagccccaagcggtggatctacgatacaagcaagctggcctctggcgtgcccagcagattttctggctctggcagcggcaccgactacaccctgacaatcagcagcatgcagcctgaggatgccgccacctactactgccagcagtggtccagcaatcccctgacatttggcggaggcaccaaggtggaaatcaagggcggaagcagcggcgacatccagatgacacagagccctagcagcctgtctgccagcgtgggagacagagtgaccatcacatgtcacgccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacttcgccacctactattgtcagcagggccagacatacccctacacctttggcggcggaacaaaggtggaaatcaagggtggcggaggaagcggcggatcaggatctggcggcggaggatctgctagcggatctggacaggttcagctggttcagtctggcgccgaagtgaagaaacctggcgcctctgtgaaggtgtcctgcaaggccagcggctacacctttaccagctactacatccactgggtccgacaggcccctggacaaggactggaatggatcggcagcatctaccccggcaacgtgaacaccaactacaacgagaagttcaaggaccgggccacactgaccgtggacacctctatcagcaccgcctacatggaactgagccggctgagatccgatgataccgccgtgtacttctgcaccagaagccactacggcctggactggaacttcgatgtgtggggccagggcaccaccgtgacagtttcttctggtggatctagtggccaggttcagctggttcagtctggcgccgaagtggctaaacctggcgcctccgtgaaggtgtcctgtaaagccagcggctacacattcacccggtacaccatgcactgggtcaagcaggctccaggacaaggcttggagtggatcggctacatcaaccctagccggggctacaccaattacgcccagaagttccagggcaaggccacactgaccaccgacaagagcacaagcaccgcctacatggaactgagcagcctgagaagcgaggacaccgccgtgtactactgtgcccggtactacgacgaccactacagcctggattattggggccagggcacaaccctgaccgtgtcatctgcttctggaggctccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggcggaggatcctctggatctggaagcggcggctctggctctagcggagtgtctcacagatacagcagaatccagagcatcaaggtgcagttcaccgagtacaagaaagagaagggcttcatcctgaccagccagaaagaggacgagatcatgaaggtgcagaacaacagcgtgatcatcaactgcgacggcttctacctgatcagcctgaagggctacttcagccaagaagtgaacatcagcctgcactaccagaaggacgaggaacccctgttccagctgaagaaagtgcggagcgtgaacagcctgatggtggccagcctgacctacaaggacaaggtgtacctgaacgtgaccaccgacaacaccagcctggacgacttccatgtgaatggcggcgagctgatcctgatccatcagaaccctggcgagttctgcgtgctcggaggatctggtggatctggcggtggaagttctggtagcggcgtgtcccatcggtacagccggattcagtccattaaggtccagtttacagagtataagaaagaaaaaggattcattctcacctctcagaaagaagatgagattatgaaggtccaaaacaattccgtcatcatcaattgtgacgggttttatctcatctccctcaagggctatttctctcaagaagtcaatatctcactccactatcagaaagatgaagaaccgctctttcagctcaaaaaagttcgctccgtgaactctctgatggtcgcctctctgacgtataaggacaaagtctatctcaatgtcacgacggacaacacatccctcgacgatttccacgtcaacggcggagaactgattctcattcaccagaatcctggggagttttgtgtcctcggcggaagtggtggaagcggaggcggaagttcaggctctggcgtcagccaccgctactccaggattcaatccatcaaagttcaattcacagagtacaaaaaagaaaaaggttttatcctgacgtcccaaaaagaggacgaaattatgaaggttcaaaacaactctgtgatcattaactgtgacggtttttacttgatctctctgaagggatacttttcccaagaagtcaacatttccctgcattatcaaaaggatgaggaaccacttttccaattgaaaaaagttcggagcgtcaactcactcatggtggcttccctgacgtacaaagataaggtttacttgaatgtcaccacagataatacgagcctcgatgactttcatgttaacggtggcgaactcatactgatccaccaaaatccaggcgaattctgtgtgctg

SEQ ID NO: 293 - protein, 1153 aa, synthetic construct
  REGION 1..1153: note = CD28xCD3_LALAPA_hOX40L
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKGGGGSGGSGSGGGGSASGSGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGSSGSGSGGSGSSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGSGGSGGGSSGSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGSGGSGGGSSGSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 294 - DNA, 3459 bp, synthetic construct
  misc_feature 1..3459: note = CD28xCD3_LALAPA_hOX40L
  source 1..3459: mol_type = other DNA
gacatccagatgacacagagccctagcagcctgtctgccagcgtgggagacagagtgaccatcacatgtcacgccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacttcgccacctactattgtcagcagggccagacatacccctacacctttggcggcggaacaaaggtggaaatcaagggcggaagcagcggcgacatccagctgacacagagcccttctagcctgtctgccagcgtgggcgacagagtgaccatcacatgtagagccagccagagcatcagctacctgaactggtatcagcagaagcccggcaagagccccaagcggtggatctacgatacaagcaagctggcctctggcgtgcccagcagattttctggctctggcagcggcaccgactacaccctgacaatcagcagcatgcagcctgaggatgccgccacctactactgccagcagtggtccagcaatcccctgacatttggcggaggcaccaaggtggaaatcaagggtggcggaggaagcggcggatcaggatctggcggcggaggatctgctagcggatctggacaggttcagctggttcagtctggcgccgaagtggctaaacctggcgcctccgtgaaggtgtcctgtaaagccagcggctacacattcacccggtacaccatgcactgggtcaagcaggctccaggacaaggcttggagtggatcggctacatcaaccctagccggggctacaccaattacgcccagaagttccagggcaaggccacactgaccaccgacaagagcacaagcaccgcctacatggaactgagcagcctgagaagcgaggacaccgccgtgtactactgtgcccggtactacgacgaccactacagcctggattattggggccagggcacaaccctgaccgtgtcatctggtggatctagtggccaggttcagctggttcagtctggcgccgaagtgaagaaacctggcgcctctgtgaaggtgtcctgcaaggccagcggctacacctttaccagctactacatccactgggtccgacaggcccctggacaaggactggaatggatcggcagcatctaccccggcaacgtgaacaccaactacaacgagaagttcaaggaccgggccacactgaccgtggacacctctatcagcaccgcctacatggaactgagccggctgagatccgatgataccgccgtgtacttctgcaccagaagccactacggcctggactggaacttcgatgtgtggggccagggcaccaccgtgacagtttcttctgcttctggaggctccggagacaagacccacacctgtcctccatgtcctgctccagaagctgctggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggaaccccaggtttacacactgcctccaagcagggacgagctgaccaagaatcaggtgtccctgacctgcctcgtgaagggcttttaccccagcgacattgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctggaggaggatcctctggatctggaagcggcggctctggctctagcggagtgtctcacagatacagcagaatccagagcatcaaggtgcagttcaccgagtacaagaaagagaagggcttcatcctgaccagccagaaagaggacgagatcatgaaggtgcagaacaacagcgtgatcatcaactgcgacggcttctacctgatcagcctgaagggctacttcagccaagaagtgaacatcagcctgcactaccagaaggacgaggaacccctgttccagctgaagaaagtgcggagcgtgaacagcctgatggtggccagcctgacctacaaggacaaggtgtacctgaacgtgaccaccgacaacaccagcctggacgacttccatgtgaatggcggcgagctgatcctgatccatcagaaccctggcgagttctgcgtgctcggaggatctggtggatctggcggtggaagttctggtagcggcgtgtcccatcggtacagccggattcagtccattaaggtccagtttacagagtataagaaagaaaaaggattcattctcacctctcagaaagaagatgagattatgaaggtccaaaacaattccgtcatcatcaattgtgacgggttttatctcatctccctcaagggctatttctctcaagaagtcaatatctcactccactatcagaaagatgaagaaccgctctttcagctcaaaaaagttcgctccgtgaactctctgatggtcgcctctctgacgtataaggacaaagtctatctcaatgtcacgacggacaacacatccctcgacgatttccacgtcaacggcggagaactgattctcattcaccagaatcctggggagttttgtgtcctcggcggaagtggtggaagcggaggcggaagttcaggctctggcgtcagccaccgctactccaggattcaatccatcaaagttcaattcacagagtacaaaaaagaaaaaggttttatcctgacgtcccaaaaagaggacgaaattatgaaggttcaaaacaactctgtgatcattaactgtgacggtttttacttgatctctctgaagggatacttttcccaagaagtcaacatttccctgcattatcaaaaggatgaggaaccacttttccaattgaaaaaagttcggagcgtcaactcactcatggtggcttccctgacgtacaaagataaggtttacttgaatgtcaccacagataatacgagcctcgatgactttcatgttaacggtggcgaactcatactgatccaccaaaatccaggcgaattctgtgtgctg

SEQ ID NO: 295 - protein, 1153 aa, synthetic construct
  REGION 1..1153: note = CD3xCD28_LALAPA_hOX40L
DIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKGGSSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGGGSGGSGSGGGGSASGSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSSGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGSSGSGSGGSGSSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGSGGSGGGSSGSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGSGGSGGGSSGSGVSHRYSRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 296 - DNA, 3459 bp, synthetic construct
  misc_feature 1..3459: note = CD3xCD28_LALAPA_hOX40L
  source 1..3459: mol_type = other DNA
gacatccagctgacacagagcccttctagcctgtctgccagcgtgggcgacagagtgaccatcacatgtagagccagccagagcatcagctacctgaactggtatcagcagaagcccggcaagagccccaagcggtggatctacgatacaagcaagctggcctctggcgtgcccagcagattttctggctctggcagcggcaccgactacaccctgacaatcagcagcatgcagcctgaggatgccgccacctactactgccagcagtggtccagcaatcccctgacatttggcggaggcaccaaggtggaaatcaagggcggaagcagcggcgacatccagatgacacagagccctagcagcctgtctgccagcgtgggagacagagtgaccatcacatgtcacgccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacttcgccacctactattgtcagcagggccagacatacccctacacctttggcggcggaacaaaggtggaaatcaagggtggcggaggaagcggcggatcaggatctggcggcggaggatctgctagcggatctggacaggttcagctggttcagtctggcgccgaagtgaagaaacctggcgcctctgtgaaggtgtcctgcaaggccagcggctacacctttaccagctactacatccactgggtccgacaggcccctggacaaggactggaatggatcggcagcatctaccccggcaacgtgaacaccaactacaacgagaagttcaaggaccgggccacactgaccgtggacacctctatcagcaccgcctacatggaactgagccggctgagatccgatgataccgccgtgtacttctgcaccagaagccactacggcctggactggaacttcgatgtgtggggccagggcaccaccgtgacagtttcttctggtggatctagtggccaggttcagctggttcagtctggcgccgaagtggctaaacctggcgcctccgtgaaggtgtcctgtaaagccagcggctacacattcacccggtacaccatgcactgggtcaagcaggctccaggacaaggcttggagtggatcggctacatcaaccctagccggggctacaccaattacgcccagaagttccagggcaaggccacactgaccaccgacaagagcacaagcaccgcctacatggaactgagcagcctgagaagcgaggacaccgccgtgtactactgtgcccggtactacgacgaccactacagcctggattattggggccagggcacaaccctgaccgtgtcatctgcttctggaggctccggagacaagacccacacctgtcctccatgtcctgctccagaagctgctggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggaaccccaggtttacacactgcctccaagcagggacgagctgaccaagaatcaggtgtccctgacctgcctcgtgaagggcttttaccccagcgacattgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctggaggaggatcctctggatctggaagcggcggctctggctctagcggagtgtctcacagatacagcagaatccagagcatcaaggtgcagttcaccgagtacaagaaagagaagggcttcatcctgaccagccagaaagaggacgagatcatgaaggtgcagaacaacagcgtgatcatcaactgcgacggcttctacctgatcagcctgaagggctacttcagccaagaagtgaacatcagcctgcactaccagaaggacgaggaacccctgttccagctgaagaaagtgcggagcgtgaacagcctgatggtggccagcctgacctacaaggacaaggtgtacctgaacgtgaccaccgacaacaccagcctggacgacttccatgtgaatggcggcgagctgatcctgatccatcagaaccctggcgagttctgcgtgctcggaggatctggtggatctggcggtggaagttctggtagcggcgtgtcccatcggtacagccggattcagtccattaaggtccagtttacagagtataagaaagaaaaaggattcattctcacctctcagaaagaagatgagattatgaaggtccaaaacaattccgtcatcatcaattgtgacgggttttatctcatctccctcaagggctatttctctcaagaagtcaatatctcactccactatcagaaagatgaagaaccgctctttcagctcaaaaaagttcgctccgtgaactctctgatggtcgcctctctgacgtataaggacaaagtctatctcaatgtcacgacggacaacacatccctcgacgatttccacgtcaacggcggagaactgattctcattcaccagaatcctggggagttttgtgtcctcggcggaagtggtggaagcggaggcggaagttcaggctctggcgtcagccaccgctactccaggattcaatccatcaaagttcaattcacagagtacaaaaaagaaaaaggttttatcctgacgtcccaaaaagaggacgaaattatgaaggttcaaaacaactctgtgatcattaactgtgacggtttttacttgatctctctgaagggatacttttcccaagaagtcaacatttccctgcattatcaaaaggatgaggaaccacttttccaattgaaaaaagttcggagcgtcaactcactcatggtggcttccctgacgtacaaagataaggtttacttgaatgtcaccacagataatacgagcctcgatgactttcatgttaacggtggcgaactcatactgatccaccaaaatccaggcgaattctgtgtgctg

SEQ ID NO: 297 - protein, 1050 aa, synthetic construct
  REGION 1..1050: note = ahCD28 TGNcs_ScFv_Kcc_41BBLrw8 LALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGGGSGGSGSGGGGSASGSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGSGGGSGLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGS

SEQ ID NO: 298 - DNA, 3150 bp, synthetic construct
  misc_feature 1..3150: note = ahCD28 TGNcs_ScFv_Kcc_41BBLrw8 LALAPA
  source 1..3150: mol_type = other DNA
gacattcaaatgacacagtctccttcttccctgtccgccagcgtcggcgatagagttactatcacctgtcatgccagccaaaatatttacgtgtggctcaactggtatcaacagaaaccgggcaaggcgccaaagctgctgatatacaaagcctctaatctgcatacaggcgtgccctctcggttctccggcagtggcagcggaacagactttaccctgactatctctagcctgcaaccggaagatttcgccacatattactgccagcagggtcagacctatccttatactttcggcggcggaactaaagttgaaatcaaaggcggcggcggtagcggcggctccggcagcggtggtggtggtagtgcgtcaggatctggccaagttcaactcgtgcagtcaggtgcggaagtaaagaagccaggagccagcgtcaaggttagttgcaaagcaagcggttataccttcacgtcctattacatccattgggtgcgccaagcgcctggccaaggcctggagtggattggtagtatctacccggggaatgtcaacacaaactataatgaaaagttcaaagatagggccaccttgactgtggacacatctatctccactgcttatatggagctgtcacgtctccgtagtgacgataccgctgtctatttctgcactagaagccactacgggctggattggaactttgatgtatggggccaaggtacgactgtgactgtctcttccgcatctggtgggtccggagataagacccacacatgtcctccatgtcctgctccagaagctgccggcggaccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctggctgcccctatcgagaaaaccatcagcaaggccaagggccagcctagggaaccccaggtttacacccttcctccatgccgggatgagctgaccaagaaccaggtgtccctgtggtgtctggtcaagggcttctaccccagcgacattgccgtggaatgggagagcaatggccagcctgagaacaactacaagaccacacctcctgtgctggactccgacggatcattcttcctgtacagcaagctgactgtggacaagagcagatggcagcagggcaacgtgttcagctgcagcgtgatgcacgaggccctgcacaaccactacacacagaagtccctgtctctgagccctggcggaggatccggatctggcggaggatctggactgagagagggacctgagctgagccctgatgatcctgctggactgctggatctgcggcagggaatgtttgctcagctggtggcccagaacgtgctgctgattgatggccctctgagctggtacagcgatcctggacttgctggcgttagcctgactggcggcctgagctacaaagaggacaccaaagaactggtggtggccaaggccggcgtgtactacgtgttctttcagctggaactgcggagagtggtggccggcgaaggttctggatctgtgtctctggctctgcatctgcagcctctgagatcagctgctggtgctgctgctctggccctgacagttgatctgcctcctgcctctagcgaggccagaaacagcgcctttggcttccaaggcagactgctgcacctgtctgctggacagagactgggagtgcacctccacacagaggccagagctagacatgcctggcagctgacacagggcgctacagtgctgggcctgtttagagtgacccctgagattccagccggcctgccttctccaagaagcgagggatctctgagagaaggcccagagctgtccccagatgatccagccggactccttgacctgagacagggcatgttcgcccagctcgtcgctcagaatgtcctgctgatcgacggacccctgtcctggtattctgatccaggactggcaggcgtgtcactgacaggcggactgtcttacaaagaagatacgaaagagcttgtcgtcgccaaagctggggtctactatgtgtttttccagcttgagctgaggcgcgtggtcgctggcgaaggcagtggttctgtttcactggccctgcaccttcagccactcagaagtgctgcaggcgcagctgcactggctctcactgtggatttgcctccagccagctctgaggcccggaatagcgccttcggatttcaaggacgcctgctgcatctgagcgcaggccaaagactcggagtccatctgcacaccgaagctagagccagacacgcttggcaactcacccaaggcgcaactgtcctgggactgttccgcgtgacacctgaaatccctgccggacttccatctcctagatccgagggcagcctcagagaaggacccgaactgtctcctgacgacccagctggcctgctcgatcttaggcaagggatgttcgcacaactggtggcacaaaatgtgctcctcatcgacgggccacttagctggtactcagatcccggtcttgcaggggtgtcccttactggtggcctctcttacaaagaggatacaaaagaactcgttgtcgcaaaggcaggggtctactacgtgttcttccaactcgaactccggcgcgtcgtggcaggcgaaggctcaggttcagttagcctggcactccacttgcagccccttagaagcgcagctggcgcagcagctcttgcactgactgtcgatcttccaccagccagcagcgaggctaggaactccgcttttggttttcaaggcaggctcctccatctctctgccggccaaaggcttggcgtccaccttcatactgaggctagggctcgtcacgcatggcagttgactcaaggtgccacagtcctcgggctgttcagagtcactccagaaatccccgctggcttgcccagtcctagaagtgaaggatct

SEQ ID NO: 299 - protein, 1025 aa, synthetic construct
  REGION 1..1025: note = CD3_HRw11_Hcc_41BBLrw LALAPA
QVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGSGSGGGSGLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGS

SEQ ID NO: 300 - DNA, 3075 bp, synthetic construct
  misc_feature 1..3075: note = CD3_HRw11_Hcc_41BBLrw LALAPA
  source 1..3075: mol_type = other DNA
caggttcagctggttcagtctggcgccgaagtggctaaacctggcgcctccgtgaaggtgtcctgtaaagccagcggctacacattcacccggtacaccatgcactgggtcaagcaggctccaggacaaggcttggagtggatcggctacatcaaccctagccggggctacaccaattacgcccagaagttccagggcaaggccacactgaccaccgacaagagcacaagcaccgcctacatggaactgagcagcctgagaagcgaggacaccgccgtgtactactgtgcccggtactacgacgaccactacagcctggattattggggccagggcacaaccctgaccgtgtcatctgcttcgaccaagggcccatccgtgtttcctctggctcccagcagcaagtctacaagcggaggaacagccgctctgggctgcctggtcaaggattactttcccgagcctgtgaccgtgtcctggaattctggcgctctgacaagcggcgtgcacacctttccagctgtgctgcaaagcagcggcctgtactctctgagcagcgtggtcacagtgcctagctctagcctgggcacccagacctacatctgcaatgtgaaccacaagcctagcaacaccaaggtggacaagaaggtggaacccaagagctgcgctagcggaggctccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggcggaggatccggatctggcggaggatctggactgagagagggacctgagctgagccctgatgatcctgctggactgctggatctgcggcagggaatgtttgctcagctggtggcccagaacgtgctgctgattgatggccctctgagctggtacagcgatcctggacttgctggcgttagcctgactggcggcctgagctacaaagaggacaccaaagaactggtggtggccaaggccggcgtgtactacgtgttctttcagctggaactgcggagagtggtggccggcgaaggttctggatctgtgtctctggctctgcatctgcagcctctgagatcagctgctggtgctgctgctctggccctgacagttgatctgcctcctgcctctagcgaggccagaaacagcgcctttggcttccaaggcagactgctgcacctgtctgctggacagagactgggagtgcacctccacacagaggccagagctagacatgcctggcagctgacacagggcgctacagtgctgggcctgtttagagtgacccctgagattccagccggcctgccttctccaagaagcgagggatctctgagagaaggcccagagctgtccccagatgatccagccggactccttgacctgagacagggcatgttcgcccagctcgtcgctcagaatgtcctgctgatcgacggacccctgtcctggtattctgatccaggactggcaggcgtgtcactgacaggcggactgtcttacaaagaagatacgaaagagcttgtcgtcgccaaagctggggtctactatgtgtttttccagcttgagctgaggcgcgtggtcgctggcgaaggcagtggttctgtttcactggccctgcaccttcagccactcagaagtgctgcaggcgcagctgcactggctctcactgtggatttgcctccagccagctctgaggcccggaatagcgccttcggatttcaaggacgcctgctgcatctgagcgcaggccaaagactcggagtccatctgcacaccgaagctagagccagacacgcttggcaactcacccaaggcgcaactgtcctgggactgttccgcgtgacacctgaaatccctgccggacttccatctcctagatccgagggcagcctcagagaaggacccgaactgtctcctgacgacccagctggcctgctcgatcttaggcaagggatgttcgcacaactggtggcacaaaatgtgctcctcatcgacgggccacttagctggtactcagatcccggtcttgcaggggtgtcccttactggtggcctctcttacaaagaggatacaaaagaactcgttgtcgcaaaggcaggggtctactacgtgttcttccaactcgaactccggcgcgtcgtggcaggcgaaggctcaggttcagttagcctggcactccacttgcagccccttagaagcgcagctggcgcagcagctcttgcactgactgtcgatcttccaccagccagcagcgaggctaggaactccgcttttggttttcaaggcaggctcctccatctctctgccggccaaaggcttggcgtccaccttcatactgaggctagggctcgtcacgcatggcagttgactcaaggtgccacagtcctcgggctgttcagagtcactccagaaatccccgctggcttgcccagtcctagaagtgaaggatct

SEQ ID NO: 301 - protein, 797 aa, synthetic construct
  REGION 1..797: note = hu IgG1 Fc stump_Kcc_4-1BB LALAPA
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGSGGGSGLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGS

SEQ ID NO: 302 - DNA, 2391 bp, synthetic construct
  misc_feature 1..2391: note = hu IgG1 Fc stump_Kcc_4-1BB LALAPA
  source 1..2391: mol_type = other DNA
gataagacccacacatgtcctccatgtcctgctccagaagctgctggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggaaccccaggtttacacccttcctccatgccgggatgagctgaccaagaaccaggtgtccctgtggtgtctggtcaagggcttctaccccagcgacattgccgtggaatgggagagcaatggccagcctgagaacaactacaagaccacacctcctgtgctggactccgacggatcattcttcctgtacagcaagctgactgtggacaagagcagatggcagcagggcaacgtgttcagctgcagcgtgatgcacgaggccctgcacaaccactacacacagaagtccctgtctctgagccctggcggaggatccggatctggcggaggatctggactgagagagggacctgagctgagccctgatgatcctgctggactgctggatctgcggcagggaatgtttgctcagctggtggcccagaacgtgctgctgattgatggccctctgagctggtacagcgatcctggacttgctggcgttagcctgactggcggcctgagctacaaagaggacaccaaagaactggtggtggccaaggccggcgtgtactacgtgttctttcagctggaactgcggagagtggtggccggcgaaggttctggatctgtgtctctggctctgcatctgcagcctctgagatcagctgctggtgctgctgctctggccctgacagttgatctgcctcctgcctctagcgaggccagaaacagcgcctttggcttccaaggcagactgctgcacctgtctgctggacagagactgggagtgcacctccacacagaggccagagctagacatgcctggcagctgacacagggcgctacagtgctgggcctgtttagagtgacccctgagattccagccggcctgccttctccaagaagcgagggatctctgagagaaggcccagagctgtccccagatgatccagccggactccttgacctgagacagggcatgttcgcccagctcgtcgctcagaatgtcctgctgatcgacggacccctgtcctggtattctgatccaggactggcaggcgtgtcactgacaggcggactgtcttacaaagaagatacgaaagagcttgtcgtcgccaaagctggggtctactatgtgtttttccagcttgagctgaggcgcgtggtcgctggcgaaggcagtggttctgtttcactggccctgcaccttcagccactcagaagtgctgcaggcgcagctgcactggctctcactgtggatttgcctccagccagctctgaggcccggaatagcgccttcggatttcaaggacgcctgctgcatctgagcgcaggccaaagactcggagtccatctgcacaccgaagctagagccagacacgcttggcaactcacccaaggcgcaactgtcctgggactgttccgcgtgacacctgaaatccctgccggacttccatctcctagatccgagggcagcctcagagaaggacccgaactgtctcctgacgacccagctggcctgctcgatcttaggcaagggatgttcgcacaactggtggcacaaaatgtgctcctcatcgacgggccacttagctggtactcagatcccggtcttgcaggggtgtcccttactggtggcctctcttacaaagaggatacaaaagaactcgttgtcgcaaaggcaggggtctactacgtgttcttccaactcgaactccggcgcgtcgtggcaggcgaaggctcaggttcagttagcctggcactccacttgcagccccttagaagcgcagctggcgcagcagctcttgcactgactgtcgatcttccaccagccagcagcgaggctaggaactccgcttttggttttcaaggcaggctcctccatctctctgccggccaaaggcttggcgtccaccttcatactgaggctagggctcgtcacgcatggcagttgactcaaggtgccacagtcctcgggctgttcagagtcactccagaaatccccgctggcttgcccagtcctagaagtgaaggatct

SEQ ID NO: 303 - protein, 1285 aa, synthetic construct
  REGION 1..1285: note = ahCD28xCD3_Hcc_4-1BB LALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKGGGGSGGSGSGGGGSASGSGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGSGSGGGSGLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGS

SEQ ID NO: 304 - DNA, 3855 bp, synthetic construct
  misc_feature 1..3855: note = ahCD28xCD3_Hcc_4-1BB LALAPA
  source 1..3855: mol_type = other DNA
gacatccagatgacacagagccctagcagcctgtctgccagcgtgggagacagagtgaccatcacatgtcacgccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacttcgccacctactattgtcagcagggccagacatacccctacacctttggcggcggaacaaaggtggaaatcaagggcggaagcagcggcgacatccagctgacacagagcccttctagcctgtctgccagcgtgggcgacagagtgaccatcacatgtagagccagccagagcatcagctacctgaactggtatcagcagaagcccggcaagagccccaagcggtggatctacgatacaagcaagctggcctctggcgtgcccagcagattttctggctctggcagcggcaccgactacaccctgacaatcagcagcatgcagcctgaggatgccgccacctactactgccagcagtggtccagcaatcccctgacatttggcggaggcaccaaggtggaaatcaagggtggcggaggaagcggcggatcaggatctggcggcggaggatctgctagcggatctggacaggttcagctggttcagtctggcgccgaagtggctaaacctggcgcctccgtgaaggtgtcctgtaaagccagcggctacacattcacccggtacaccatgcactgggtcaagcaggctccaggacaaggcttggagtggatcggctacatcaaccctagccggggctacaccaattacgcccagaagttccagggcaaggccacactgaccaccgacaagagcacaagcaccgcctacatggaactgagcagcctgagaagcgaggacaccgccgtgtactactgtgcccggtactacgacgaccactacagcctggattattggggccagggcacaaccctgaccgtgtcatctggtggatctagtggccaggttcagctggttcagtctggcgccgaagtgaagaaacctggcgcctctgtgaaggtgtcctgcaaggccagcggctacacctttaccagctactacatccactgggtccgacaggcccctggacaaggactggaatggatcggcagcatctaccccggcaacgtgaacaccaactacaacgagaagttcaaggaccgggccacactgaccgtggacacctctatcagcaccgcctacatggaactgagccggctgagatccgatgataccgccgtgtacttctgcaccagaagccactacggcctggactggaacttcgatgtgtggggccagggcaccaccgtgacagtttcttctgcttctggaggctccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggcggaggatccggatctggcggaggatctggactgagagagggacctgagctgagccctgatgatcctgctggactgctggatctgcggcagggaatgtttgctcagctggtggcccagaacgtgctgctgattgatggccctctgagctggtacagcgatcctggacttgctggcgttagcctgactggcggcctgagctacaaagaggacaccaaagaactggtggtggccaaggccggcgtgtactacgtgttctttcagctggaactgcggagagtggtggccggcgaaggttctggatctgtgtctctggctctgcatctgcagcctctgagatcagctgctggtgctgctgctctggccctgacagttgatctgcctcctgcctctagcgaggccagaaacagcgcctttggcttccaaggcagactgctgcacctgtctgctggacagagactgggagtgcacctccacacagaggccagagctagacatgcctggcagctgacacagggcgctacagtgctgggcctgtttagagtgacccctgagattccagccggcctgccttctccaagaagcgagggatctctgagagaaggcccagagctgtccccagatgatccagccggactccttgacctgagacagggcatgttcgcccagctcgtcgctcagaatgtcctgctgatcgacggacccctgtcctggtattctgatccaggactggcaggcgtgtcactgacaggcggactgtcttacaaagaagatacgaaagagcttgtcgtcgccaaagctggggtctactatgtgtttttccagcttgagctgaggcgcgtggtcgctggcgaaggcagtggttctgtttcactggccctgcaccttcagccactcagaagtgctgcaggcgcagctgcactggctctcactgtggatttgcctccagccagctctgaggcccggaatagcgccttcggatttcaaggacgcctgctgcatctgagcgcaggccaaagactcggagtccatctgcacaccgaagctagagccagacacgcttggcaactcacccaaggcgcaactgtcctgggactgttccgcgtgacacctgaaatccctgccggacttccatctcctagatccgagggcagcctcagagaaggacccgaactgtctcctgacgacccagctggcctgctcgatcttaggcaagggatgttcgcacaactggtggcacaaaatgtgctcctcatcgacgggccacttagctggtactcagatcccggtcttgcaggggtgtcccttactggtggcctctcttacaaagaggatacaaaagaactcgttgtcgcaaaggcaggggtctactacgtgttcttccaactcgaactccggcgcgtcgtggcaggcgaaggctcaggttcagttagcctggcactccacttgcagccccttagaagcgcagctggcgcagcagctcttgcactgactgtcgatcttccaccagccagcagcgaggctaggaactccgcttttggttttcaaggcaggctcctccatctctctgccggccaaaggcttggcgtccaccttcatactgaggctagggctcgtcacgcatggcagttgactcaaggtgccacagtcctcgggctgttcagagtcactccagaaatccccgctggcttgcccagtcctagaagtgaaggatct

SEQ ID NO: 305 - protein, 1285 aa, synthetic construct
  REGION 1..1285: note = CD3xCD28_Hcc_4-1BB LALAPA
DIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKGGSSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGGGSGGSGSGGGGSASGSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSSGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGSGSGGGSGLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGS

SEQ ID NO: 306 - DNA, 3855 bp, synthetic construct
  misc_feature 1..3855: note = CD3xCD28_Hcc_4-1BB LALAPA
  source 1..3855: mol_type = other DNA
gacatccagctgacacagagcccttctagcctgtctgccagcgtgggcgacagagtgaccatcacatgtagagccagccagagcatcagctacctgaactggtatcagcagaagcccggcaagagccccaagcggtggatctacgatacaagcaagctggcctctggcgtgcccagcagattttctggctctggcagcggcaccgactacaccctgacaatcagcagcatgcagcctgaggatgccgccacctactactgccagcagtggtccagcaatcccctgacatttggcggaggcaccaaggtggaaatcaagggcggaagcagcggcgacatccagatgacacagagccctagcagcctgtctgccagcgtgggagacagagtgaccatcacatgtcacgccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacttcgccacctactattgtcagcagggccagacatacccctacacctttggcggcggaacaaaggtggaaatcaagggtggcggaggaagcggcggatcaggatctggcggcggaggatctgctagcggatctggacaggttcagctggttcagtctggcgccgaagtgaagaaacctggcgcctctgtgaaggtgtcctgcaaggccagcggctacacctttaccagctactacatccactgggtccgacaggcccctggacaaggactggaatggatcggcagcatctaccccggcaacgtgaacaccaactacaacgagaagttcaaggaccgggccacactgaccgtggacacctctatcagcaccgcctacatggaactgagccggctgagatccgatgataccgccgtgtacttctgcaccagaagccactacggcctggactggaacttcgatgtgtggggccagggcaccaccgtgacagtttcttctggtggatctagtggccaggttcagctggttcagtctggcgccgaagtggctaaacctggcgcctccgtgaaggtgtcctgtaaagccagcggctacacattcacccggtacaccatgcactgggtcaagcaggctccaggacaaggcttggagtggatcggctacatcaaccctagccggggctacaccaattacgcccagaagttccagggcaaggccacactgaccaccgacaagagcacaagcaccgcctacatggaactgagcagcctgagaagcgaggacaccgccgtgtactactgtgcccggtactacgacgaccactacagcctggattattggggccagggcacaaccctgaccgtgtcatctgcttctggaggctccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggcggaggatccggatctggcggaggatctggactgagagagggacctgagctgagccctgatgatcctgctggactgctggatctgcggcagggaatgtttgctcagctggtggcccagaacgtgctgctgattgatggccctctgagctggtacagcgatcctggacttgctggcgttagcctgactggcggcctgagctacaaagaggacaccaaagaactggtggtggccaaggccggcgtgtactacgtgttctttcagctggaactgcggagagtggtggccggcgaaggttctggatctgtgtctctggctctgcatctgcagcctctgagatcagctgctggtgctgctgctctggccctgacagttgatctgcctcctgcctctagcgaggccagaaacagcgcctttggcttccaaggcagactgctgcacctgtctgctggacagagactgggagtgcacctccacacagaggccagagctagacatgcctggcagctgacacagggcgctacagtgctgggcctgtttagagtgacccctgagattccagccggcctgccttctccaagaagcgagggatctctgagagaaggcccagagctgtccccagatgatccagccggactccttgacctgagacagggcatgttcgcccagctcgtcgctcagaatgtcctgctgatcgacggacccctgtcctggtattctgatccaggactggcaggcgtgtcactgacaggcggactgtcttacaaagaagatacgaaagagcttgtcgtcgccaaagctggggtctactatgtgtttttccagcttgagctgaggcgcgtggtcgctggcgaaggcagtggttctgtttcactggccctgcaccttcagccactcagaagtgctgcaggcgcagctgcactggctctcactgtggatttgcctccagccagctctgaggcccggaatagcgccttcggatttcaaggacgcctgctgcatctgagcgcaggccaaagactcggagtccatctgcacaccgaagctagagccagacacgcttggcaactcacccaaggcgcaactgtcctgggactgttccgcgtgacacctgaaatccctgccggacttccatctcctagatccgagggcagcctcagagaaggacccgaactgtctcctgacgacccagctggcctgctcgatcttaggcaagggatgttcgcacaactggtggcacaaaatgtgctcctcatcgacgggccacttagctggtactcagatcccggtcttgcaggggtgtcccttactggtggcctctcttacaaagaggatacaaaagaactcgttgtcgcaaaggcaggggtctactacgtgttcttccaactcgaactccggcgcgtcgtggcaggcgaaggctcaggttcagttagcctggcactccacttgcagccccttagaagcgcagctggcgcagcagctcttgcactgactgtcgatcttccaccagccagcagcgaggctaggaactccgcttttggttttcaaggcaggctcctccatctctctgccggccaaaggcttggcgtccaccttcatactgaggctagggctcgtcacgcatggcagttgactcaaggtgccacagtcctcgggctgttcagagtcactccagaaatccccgctggcttgcccagtcctagaagtgaaggatct

SEQ ID NO: 307 - protein, 1285 aa, synthetic construct
  REGION 1..1285: note = CD28xCD3_LALAPA_4-1BB
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKGGGGSGGSGSGGGGSASGSGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGSGSGGGSGLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGS

SEQ ID NO: 308 - DNA, 3855 bp, synthetic construct
  misc_feature 1..3855: note = CD28xCD3_LALAPA_4-1BB
  source 1..3855: mol_type = other DNA
gacatccagatgacacagagccctagcagcctgtctgccagcgtgggagacagagtgaccatcacatgtcacgccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacttcgccacctactattgtcagcagggccagacatacccctacacctttggcggcggaacaaaggtggaaatcaagggcggaagcagcggcgacatccagctgacacagagcccttctagcctgtctgccagcgtgggcgacagagtgaccatcacatgtagagccagccagagcatcagctacctgaactggtatcagcagaagcccggcaagagccccaagcggtggatctacgatacaagcaagctggcctctggcgtgcccagcagattttctggctctggcagcggcaccgactacaccctgacaatcagcagcatgcagcctgaggatgccgccacctactactgccagcagtggtccagcaatcccctgacatttggcggaggcaccaaggtggaaatcaagggtggcggaggaagcggcggatcaggatctggcggcggaggatctgctagcggatctggacaggttcagctggttcagtctggcgccgaagtggctaaacctggcgcctccgtgaaggtgtcctgtaaagccagcggctacacattcacccggtacaccatgcactgggtcaagcaggctccaggacaaggcttggagtggatcggctacatcaaccctagccggggctacaccaattacgcccagaagttccagggcaaggccacactgaccaccgacaagagcacaagcaccgcctacatggaactgagcagcctgagaagcgaggacaccgccgtgtactactgtgcccggtactacgacgaccactacagcctggattattggggccagggcacaaccctgaccgtgtcatctggtggatctagtggccaggttcagctggttcagtctggcgccgaagtgaagaaacctggcgcctctgtgaaggtgtcctgcaaggccagcggctacacctttaccagctactacatccactgggtccgacaggcccctggacaaggactggaatggatcggcagcatctaccccggcaacgtgaacaccaactacaacgagaagttcaaggaccgggccacactgaccgtggacacctctatcagcaccgcctacatggaactgagccggctgagatccgatgataccgccgtgtacttctgcaccagaagccactacggcctggactggaacttcgatgtgtggggccagggcaccaccgtgacagtttcttctgcttctggaggctccggagacaagacccacacctgtcctccatgtcctgctccagaagctgctggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggaaccccaggtttacacactgcctccaagcagggacgagctgaccaagaatcaggtgtccctgacctgcctcgtgaagggcttttaccccagcgacattgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctggaggaggatccggatctggcggaggatctggactgagagagggacctgagctgagccctgatgatcctgctggactgctggatctgcggcagggaatgtttgctcagctggtggcccagaacgtgctgctgattgatggccctctgagctggtacagcgatcctggacttgctggcgttagcctgactggcggcctgagctacaaagaggacaccaaagaactggtggtggccaaggccggcgtgtactacgtgttctttcagctggaactgcggagagtggtggccggcgaaggttctggatctgtgtctctggctctgcatctgcagcctctgagatcagctgctggtgctgctgctctggccctgacagttgatctgcctcctgcctctagcgaggccagaaacagcgcctttggcttccaaggcagactgctgcacctgtctgctggacagagactgggagtgcacctccacacagaggccagagctagacatgcctggcagctgacacagggcgctacagtgctgggcctgtttagagtgacccctgagattccagccggcctgccttctccaagaagcgagggatctctgagagaaggcccagagctgtccccagatgatccagccggactccttgacctgagacagggcatgttcgcccagctcgtcgctcagaatgtcctgctgatcgacggacccctgtcctggtattctgatccaggactggcaggcgtgtcactgacaggcggactgtcttacaaagaagatacgaaagagcttgtcgtcgccaaagctggggtctactatgtgtttttccagcttgagctgaggcgcgtggtcgctggcgaaggcagtggttctgtttcactggccctgcaccttcagccactcagaagtgctgcaggcgcagctgcactggctctcactgtggatttgcctccagccagctctgaggcccggaatagcgccttcggatttcaaggacgcctgctgcatctgagcgcaggccaaagactcggagtccatctgcacaccgaagctagagccagacacgcttggcaactcacccaaggcgcaactgtcctgggactgttccgcgtgacacctgaaatccctgccggacttccatctcctagatccgagggcagcctcagagaaggacccgaactgtctcctgacgacccagctggcctgctcgatcttaggcaagggatgttcgcacaactggtggcacaaaatgtgctcctcatcgacgggccacttagctggtactcagatcccggtcttgcaggggtgtcccttactggtggcctctcttacaaagaggatacaaaagaactcgttgtcgcaaaggcaggggtctactacgtgttcttccaactcgaactccggcgcgtcgtggcaggcgaaggctcaggttcagttagcctggcactccacttgcagccccttagaagcgcagctggcgcagcagctcttgcactgactgtcgatcttccaccagccagcagcgaggctaggaactccgcttttggttttcaaggcaggctcctccatctctctgccggccaaaggcttggcgtccaccttcatactgaggctagggctcgtcacgcatggcagttgactcaaggtgccacagtcctcgggctgttcagagtcactccagaaatccccgctggcttgcccagtcctagaagtgaaggatct

SEQ ID NO: 309 - protein, 1285 aa, synthetic construct
  REGION 1..1285: note = CD3xCD28_LALAPA_4-1BB
DIQLTQSPSSLSASVGDRVTITCRASQSISYLNWYQQKPGKSPKRWIYDTSKLASGVPSRFSGSGSGTDYTLTISSMQPEDAATYYCQQWSSNPLTFGGGTKVEIKGGSSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGGGSGGSGSGGGGSASGSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSSGQVQLVQSGAEVAKPGASVKVSCKASGYTFTRYTMHWVKQAPGQGLEWIGYINPSRGYTNYAQKFQGKATLTTDKSTSTAYMELSSLRSEDTAVYYCARYYDDHYSLDYWGQGTTLTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGSGSGGGSGLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGS

SEQ ID NO: 310 - protein, 490 aa, synthetic construct; identical to SEQ ID NO: 98
  REGION 1..490: note = TgCD28bCD3csL1His8

SEQ ID NO: 311 - protein, 502 aa, synthetic construct; identical to SEQ ID NO: 99
  REGION 1..502: note = bCD19dCD38L1His8

SEQ ID NO: 312 - protein, 722 aa, synthetic construct; identical to SEQ ID NO: 100
  REGION 1..722: note = aCD28aCD3L1LALAPA

SEQ ID NO: 313 - protein, 722 aa, synthetic construct; identical to SEQ ID NO: 101
  REGION 1..722: note = aCD28aCD3L2LALAPA

SEQ ID NO: 314 - protein, 722 aa, synthetic construct; identical to SEQ ID NO: 102
  REGION 1..722: note = aCD3csaCD28L1LALAPA

SEQ ID NO: 315 - protein, 722 aa, synthetic construct; identical to SEQ ID NO: 103
  REGION 1..722: note = aCD3csaCD28L2LALAPA

SEQ ID NO: 316 - protein, 714 aa, synthetic construct; identical to SEQ ID NO: 104
  REGION 1..714: note = TgCD28bCD3csL1holeLALAPA

SEQ ID NO: 317 - protein, 714 aa, synthetic construct; identical to SEQ ID NO: 105
  REGION 1..714: note = bCD3csTgCD28L1holeLALAPA

SEQ ID NO: 318 - protein, 726 aa, synthetic construct
  REGION 1..726: note = bCD19dCD38L1knobLALAPA
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGSSGEIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKGGGGSGGSGSGGGGSASGSGEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSGGSSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 319 - protein, 726 aa, synthetic construct
  REGION 1..726: note = dCD38bCD19L1knobLALAPA
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKGGSSGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGSGSGGGGSASGSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGSSGEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 320 - protein, 721 aa, synthetic construct; identical to SEQ ID NO: 106
  REGION 1..721: note = bCD3csTgCD28L1CLCH1Fc(hole)LALAPA

SEQ ID NO: 321 - protein, 721 aa, synthetic construct; identical to SEQ ID NO: 107
  REGION 1..721: note = bCD3csTgCD28L1CH1CLFc(hole)LALAPA

SEQ ID NO: 322 - protein, 706 aa, synthetic construct
  REGION 1..706: note = TgCD28bCD3csL3holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 323 - protein, 724 aa, synthetic construct
  REGION 1..724: note = TgCD28bCD3csL4holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKSGGSGSSGGSDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSGGSSGSSQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 324 - protein, 718 aa, synthetic construct
  REGION 1..718: note = bCD19dCD38L3knobLALAPA
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGEIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKGGGGSGGSGSGGGGSASGSGEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 325 - protein, 736 aa, synthetic construct
  REGION 1..736: note = bCD19dCD38L4knobLALAPA
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKSGGSGSSGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKGGGGSGGSGSGGGGSASGSGEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSGGSGGSSGSSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 326 - protein, 811 aa, synthetic construct
  REGION 1..811: note = TgCD28bCD3csL1CH1rw1holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 327 - protein, 827 aa, synthetic construct
  REGION 1..827: note = bCD19dCD38L1CLrw1knobLALAPA
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGSSGEIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKGGGGSGGSGSGGGGSASGSGEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSGGSSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSATVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 328 - protein, 811 aa, synthetic construct
  REGION 1..811: note = TgCD28bCD3csL1CH1rw2holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 329 - protein, 611 aa, synthetic construct
  REGION 1..611: note = bCD19dCD38L1CLrw2 knobLALAPA
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGSSGEIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKGGGGSGGSGSGGGGSASGSGEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSGGSSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSATVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGESDKTHTCPPCP

SEQ ID NO: 330 - protein, 813 aa, synthetic construct
  REGION 1..813: note = TgCD28bCD3csL1CH1rw3 holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKTPLGDTTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 331 - protein, 830 aa, synthetic construct
  REGION 1..830: note = bCD19dCD38L1CLrw3knobLALAPA
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGSSGEIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKGGGGSGGSGSGGGGSASGSGEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSGGSSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSATVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGETPLGDTTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 332 - protein, 814 aa, synthetic construct
  REGION 1..814: note = TgCD28bCD3csL1CH1rw4holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 333 - protein, 829 aa, synthetic construct
  REGION 1..829: note = bCD19dCD38L1CLrw4knobLALAPA
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGSSGEIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKGGGGSGGSGSGGGGSASGSGEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSGGSSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 334 - protein, 816 aa, synthetic construct
  REGION 1..816: note = TgCD28bCD3csL1CH1rw5holeLALAPA
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGSGSGGGGSASGSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGSSGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 335 - protein, 831 aa, synthetic construct
  REGION 1..831: note = bCD19dCD38L1CLrw5knobLALAPA
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGSSGEIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKGGGGSGGSGSGGGGSASGSGEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSGGSSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASGGSTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 336 - protein, 714 aa, synthetic construct
  REGION 1..714: note = TgCD28bCD3csL1HHLLholeLALAPA
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGSSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGGGSGGSGSGGGGSASGSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 337 - protein, 714 aa, synthetic construct
  REGION 1..714: note = bCD3csTgCD28L1HHLLholeLALAPA
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGGGSGGSGSGGGGSASGSGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSSGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 338 - protein, 726 aa, synthetic construct
  REGION 1..726: note = bCD19dCD38L1HHLLknobLALAPA
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSGGSSGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGSGSGGGGSASGSGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGSSGEIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 339 - protein, 726 aa, synthetic construct
  REGION 1..726: note = dCD38bCD19L1HHLLknobLALAPA
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGSSGEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSGGGGSGGSGSGGGGSASGSGEIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKGGSSGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 340 - protein, 940 aa, synthetic construct
  REGION 1..940: note = bCD3cstHer2L1scFcLALAPArw1
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSSGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGSGSGGGGSASGSGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGSSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 341 - protein, 979 aa, synthetic construct
  REGION 1..979: note = bCD3cstHer2L1scFcLALAPArw2
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSSGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGSGSGGGGSASGSGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGSSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGSGGSGGGSSGGGGSGGGGSGGGGSGGGGSGGGGSSSSTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 342 - protein, 981 aa, synthetic construct
  REGION 1..981: note = bCD3cstHer2L1scFcLALAPArw3
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSSGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGSGSGGGGSASGSGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGSSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGSGGSGGGSSGGGGSGGGGSGGGGSGGGGSGGGGSSSSGSTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 343 - protein, 720 aa, synthetic construct
  REGION 1..720: note = bCD3cstHer2L1scCH3rw1
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSSGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGSGSGGGGSASGSGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGSSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASGGSGGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSSGGGGSGGSGSGGSGSGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 344 - protein, 722 aa, synthetic construct
  REGION 1..722: note = bCD3cstHer2L1scCH3rw2
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSSGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGSGSGGGGSASGSGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGSSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASGGSGGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGSGSSGGGGSGGSGSGGSGSSGGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 345 - protein, 756 aa, synthetic construct
  REGION 1..756: note = bCD3cstHer2L1scCH3rw5
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSSGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGSGSGGGGSASGSGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGSSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASGGSGSSGCPPCPAPEAAGGPSGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGSGSSGGGGSGGSGSGGSGSSGSSGCPPCPAPEAAGGPSGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 346 - protein, 752 aa, synthetic construct
  REGION 1..752: note = bCD3cstHer2L1scCH3rw6
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSSGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGSGSGGGGSASGSGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGSSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASGGSGSCPPCPAPEAAGGSSGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGSGSSGGGGSGGSGSGGSGSSGSCPPCPAPEAAGGSSGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 347 - protein, 1204 aa, synthetic construct
  REGION 1..1204: note = bCD3cstHer2L1CLCH1scFcLALAPArw1
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSSGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGSGSGGGGSASGSGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGSSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGSGSGGGGSASGSGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGSGGSGGGSSGGGGSGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 348 - protein, 982 aa, synthetic construct
  REGION 1..982: note = bCD3cstHer2L1CLCH1scCH3rw5
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSSGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGSGSGGGGSASGSGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGSSGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGSGSGGGGSASGSGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGSGSSGGGGSGGSGSGGSGSSGSSGCPPCPAPEAAGGPSGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 349 - protein, 132 aa, synthetic construct
  REGION 1..132: note = PGT121 VH
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSS

SEQ ID NO: 350 - protein, 121 aa, synthetic construct
  REGION 1..121: note = VRC01 VH
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSS

SEQ ID NO: 351 - protein, 131 aa, synthetic construct
  REGION 1..131: note = 10E8v4 VH
EVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSS

SEQ ID NO: 352 - protein, 137 aa, synthetic construct
  REGION 1..137: note = PG16 VH
QEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSS

SEQ ID NO: 353 - protein, 105 aa, synthetic construct
  REGION 1..105: note = PGT121 VL
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVL

SEQ ID NO: 354 - protein, 100 aa, synthetic construct
  REGION 1..100: note = VRC01 VL
LTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 355 - protein, 108 aa, synthetic construct
  REGION 1..108: note = 10E8v4 VL
SELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVL

SEQ ID NO: 356 - protein, 110 aa, synthetic construct
  REGION 1..110: note = PG16 VL
QSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVL

SEQ ID NO: 357 - protein, 5 aa, synthetic construct
  REGION 1..5: note = PGT121 heavy CDR1
DSYWS

SEQ ID NO: 358 - protein, 16 aa, synthetic construct
  REGION 1..16: note = PGT121 heavy CDR2
YVHKSGDTNYSPSLKS

SEQ ID NO: 359 - protein, 24 aa, synthetic construct
  REGION 1..24: note = PGT121 heavy CDR3
TLHGRRIYGIVAFNEWFTYFYMDV

SEQ ID NO: 360 - protein, 5 aa, synthetic construct
  REGION 1..5: note = VRC01 heavy CDR1
DCTLN

SEQ ID NO: 361 - protein, 17 aa, synthetic construct
  REGION 1..17: note = VRC01 heavy CDR2
WLKPRGGAVNYARPLQG

SEQ ID NO: 362 - protein, 12 aa, synthetic construct
  REGION 1..12: note = VRC01 heavy CDR3
GKNCDYNWDFEH

SEQ ID NO: 363 - protein, 5 aa, synthetic construct
  REGION 1..5: note = 10E8v4 heavy CDR1
NAWMT

SEQ ID NO: 364 - protein, 19 aa, synthetic construct
  REGION 1..19: note = 10E8v4 heavy CDR2
RITGPGEGWSVDYAESVKG

SEQ ID NO: 365 - protein, 20 aa, synthetic construct
  REGION 1..20: note = 10E8v4 heavy CDR3
TGKYYDFWSGYPPGEEYFQD

SEQ ID NO: 366 - protein, 5 aa, synthetic construct
  REGION 1..5: note = PG16 heavy CDR1
KYGMH

SEQ ID NO: 367 - protein, 17 aa, synthetic construct
  REGION 1..17: note = PG16 heavy CDR2
LISDDGMRKYHSDSMWG

SEQ ID NO: 368 - protein, 28 aa, synthetic construct
  REGION 1..28: note = PG16 heavy CDR3
EAGGPIWHDDVKYYDFNDGYYNYHYMDV

SEQ ID NO: 369 - protein, 14 aa, synthetic construct
  REGION 1..14: note = PG16 light CDR1
NGTSSDVGGFDSVS

SEQ ID NO: 370 - protein, 7 aa, synthetic construct
  REGION 1..7: note = PG16 light CDR2
DVSHRPS

SEQ ID NO: 371 - protein, 10 aa, synthetic construct
  REGION 1..10: note = PG16 light CDR3
SSLTDRSHRI

SEQ ID NO: 372 - protein, 11 aa, synthetic construct
  REGION 1..11: note = PGT121 light CDR1
GEKSLGSRAVQ

SEQ ID NO: 373 - protein, 7 aa, synthetic construct
  REGION 1..7: note = PGT121 light CDR2
NNQDRPS

SEQ ID NO: 374 - protein, 9 aa, synthetic construct
  REGION 1..9: note = PGT121 light CDR3
DSRVPTKWV

SEQ ID NO: 375 - protein, 9 aa, synthetic construct
  REGION 1..9: note = VRC01 light CDR1
RTSQYGSLA

SEQ ID NO: 376 - protein, 7 aa, synthetic construct
  REGION 1..7: note = VRC01 light CDR2
SGSTRAA

SEQ ID NO: 377 - protein, 5 aa, synthetic construct
  REGION 1..5: note = VRC01 light CDR3
QQYEF

SEQ ID NO: 378 - protein, 11 aa, synthetic construct
  REGION 1..11: note = 10E8v4 light CDR1
RGDSLRSHYAS

SEQ ID NO: 379 - protein, 7 aa, synthetic construct
  REGION 1..7: note = 10E8v4 light CDR2
GKNNRPS

SEQ ID NO: 380 - protein, 12 aa, synthetic construct
  REGION 1..12: note = 10E8v4 light CDR3
SSRDKSGSRLSV

SEQ ID NO: 381 - DNA, 1383 bp, synthetic construct
  misc_feature 1..1383: note = PGT121 VH
  source 1..1383: mol_type = other DNA
cagatgcagctccaagagtctggccctggcctggtcaagcctagcgaaacactgagcctgacctgttccgtgtccggcgccagcatcagcgatagctactggtcctggatcagaagaagccccggcaaaggcctggaatggatcggctacgtgcacaagagcggcgacaccaactatagccccagcctgaagtccagagtgaacctgagcctggacaccagcaagaaccaggtgtccctgtctctggtggccgctacagctgccgatagcggcaagtactactgcgccagaactctgcacggcagacggatctatggcatcgtggccttcaacgagtggttcacctacttctacatggacgtgtggggcaacggcacccaagtgacagtctcttctgcttcgaccaagggcccatccgtgtttcctctggctcccagcagcaagtctacaagcggaggaacagccgctctgggctgcctggtcaaggattactttcccgagcctgtgaccgtgtcctggaattctggcgctctgacaagcggcgtgcacacctttccagctgtgctgcaaagcagcggcctgtactctctgagcagcgtggtcacagtgcctagctctagcctgggcacccagacctacatctgcaatgtgaaccacaagcctagcaacaccaaggtggacaagaaggtggaacccaagagctgcgataagacccacacatgtcctccatgtcctgctccagaactgctgggcggaccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctgcccgcccctatcgagaaaaccatcagcaaggccaagggccagcctagggaaccccaggtttacacccttcctccatgccgggatgagctgaccaagaaccaggtgtccctgtggtgtctggtcaagggcttctaccccagcgacattgccgtggaatgggagagcaatggccagcctgagaacaactacaagaccacacctcctgtgctggactccgacggatcattcttcctgtacagcaagctgactgtggacaagagcagatggcagcagggcaacgtgttcagctgcagcgtgatgcacgaggccctgcacaaccactacacacagaagtccctgtctctgagccctggc

SEQ ID NO: 382 - DNA, 1398 bp, synthetic construct
  misc_feature 1..1398: note = PG16 VH
  source 1..1398: mol_type = other DNA
caagaacagctggtggaatctggtggcggagtggttcaacctggcggctctctgagactgagctgtctggcctccggcttcaccttccacaaatacggcatgcactgggtccgacaggcccctggaaaaggccttgaatgggtcgccctgatcagcgacgacggcatgagaaagtaccacagcgacagcatgtggggcagagtgaccatcagccgggacaacagcaagaacaccctgtacctgcagttcagctccctgaaggtggaagataccgccatgttcttttgcgccagagaagccggcggacccatctggcatgacgacgtgaagtactacgacttcaacgacggctactacaactaccactacatggacgtgtggggcaagggcaccaccgtgacagtttcttctgcttcgaccaagggcccatccgtgtttcctctggctcccagcagcaagtctacaagcggaggaacagccgctctgggctgcctggtcaaggattactttcccgagcctgtgaccgtgtcctggaattctggcgctctgacaagcggcgtgcacacctttccagctgtgctgcaaagcagcggcctgtactctctgagcagcgtggtcacagtgcctagctctagcctgggcacccagacctacatctgcaatgtgaaccacaagcctagcaacaccaaggtggacaagaaggtggaacccaagagctgcgataagacccacacatgtcctccatgtcctgctccagaactgctgggcggaccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctgcccgcccctatcgagaaaaccatcagcaaggccaagggccagcctagggaaccccaggtttacacccttcctccatgccgggatgagctgaccaagaaccaggtgtccctgtggtgtctggtcaagggcttctaccccagcgacattgccgtggaatgggagagcaatggccagcctgagaacaactacaagaccacacctcctgtgctggactccgacggatcattcttcctgtacagcaagctgactgtggacaagagcagatggcagcagggcaacgtgttcagctgcagcgtgatgcacgaggccctgcacaaccactacacacagaagtccctgtctctgagccctggc

SEQ ID NO: 383 - DNA, 633 bp, synthetic construct
  misc_feature 1..633: note = PGT121 VL
  source 1..633: mol_type = other DNA
agcgatatctctgtggcccctggcgagacagccagaatcagctgtggcgagaagtccctgggaagcagagccgtgcagtggtatcagcatagagccggacaggcccctagcctgatcatctacaacaaccaggacagacccagcggcatccccgagagattttctggcagccctgatagccctttcggcaccacagccacactgaccatcacatctgtggaagccggcgacgaggccgactactactgtcacatctgggacagcagggtgcccaccaaatgggttttcggcggaggcacaaccctgaccgttctgggacagcctaaggccaatcctaccgtgacactgttccctccaagcagcgaagaactgcaggccaacaaggccacactcgtgtgcctgatcagcgacttttatcctggcgccgtgaccgtggcctggaaggctgatggatctcctgtgaaagccggcgtggaaaccaccaagcctagcaagcagagcaacaacaaatacgccgccagcagctacctgagcctgacacctgagcagtggaagtcccacagatcctacagctgccaagtgacccacgagggcagcaccgtggaaaaaacagtggcccctaccgagtgcagc

SEQ ID NO: 384 - DNA, 648 bp, synthetic construct
  misc_feature 1..648: note = PG16 VL
  source 1..648: mol_type = other DNA
cagtctgctctgacacagcctgcctctgtgtctggctctcctggccagaccatcaccatcagctgtaacggcaccagctctgacgtcggcggctttgatagcgtgtcctggtatcagcagagccccggcaaagcccctaaagtgatggtgttcgatgtgtcccaccggcctagcggcatcagcaatagattcagcggcagcaagagcggcaacaccgccagcctgacaatctctggactgcacatcgaggacgagggcgactacttctgtagcagcctgaccgacagaagccaccggatttttggcggaggcaccaaagtgaccgtgctgggacagcctaaggccaatcctaccgtgacactgttccctccaagcagcgaagaactgcaggccaacaaggccacactcgtgtgcctgatcagcgacttttatcctggcgccgtgaccgtggcctggaaggctgatggatctcctgtgaaagccggcgtggaaaccaccaagcctagcaagcagagcaacaacaaatacgccgccagcagctacctgagcctgacacctgagcagtggaagtcccacagatcctacagctgccaagtgacccacgagggcagcaccgtggaaaaaacagtggcccctaccgagtgcagc

SEQ ID NO: 385 - protein, 241 aa, synthetic construct
  REGION 1..241: note = VRC01scFv
LTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKGGGGSGGSGSGGGGSASGSGQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSS

SEQ ID NO: 386 - protein, 1428 aa, synthetic construct
  REGION 1..1428: note = VRC01scFv
GAGATCGTGCTGACACAGAGCCCTGGCACCCTGAGCCTGTCTCCAGGCGAGACAGCCATCATCAGCTGCCGGACAAGCCAGTACGGCAGCCTGGCCTGGTATCAGCAGAGGCCTGGACAGGCCCCCAGACTCGTGATCTACAGCGGCAGCACAAGAGCCGCCGGAATCCCCGATAGATTCAGCGGCTCCAGATGGGGCCCTGACTACAACCTGACCATCAGCAACCTGGAAAGCGGCGACTTCGGCGTGTACTACTGCCAGCAGTACGAGTTCTTCGGCCAGGGCACCAAGGTGCAGGTGGACATCAAGGGCGGCGGAGGAAGCGGCGGATCTGGATCTGGTGGCGGAGGATCTGCTTCTGGCTCTGGACAGGTTCAGCTGGTTCAGTCTGGCGGACAGATGAAGAAACCCGGCGAGAGCATGCGGATCAGCTGTAGAGCCAGCGGCTACGAGTTCATCGACTGCACCCTGAACTGGATCAGACTGGCCCCTGGCAAAAGACCCGAGTGGATGGGATGGCTGAAGCCTAGAGGCGGAGCCGTGAATTACGCCAGACCTCTGCAGGGCAGAGTGACCATGACCAGGGACGTGTACAGCGATACCGCCTTCCTGGAACTGAGAAGCCTGACCGTGGATGATACCGCCGTGTACTTCTGCACCCGGGGCAAGAACTGCGACTACAACTGGGACTTCGAGCACTGGGGCAGAGGCACACCTGTGATCGTTAGCTCTGCTAGCGGAGGTTCCGGAGATAAGACCCACACATGTCCTCCATGTCCTGCTCCAGAACTGCTGGGCGGACCTTCCGTGTTTCTGTTCCCTCCAAAGCCTAAGGACACCCTGATGATCAGCAGGACCCCTGAAGTGACCTGCGTGGTGGTGGATGTGTCTCACGAGGACCCAGAAGTGAAGTTCAATTGGTACGTGGACGGCGTGGAAGTGCACAACGCCAAGACCAAGCCTAGAGAGGAACAGTACAACAGCACCTACAGAGTGGTGTCCGTGCTGACAGTGCTGCACCAGGATTGGCTGAACGGCAAAGAGTACAAGTGCAAGGTGTCCAACAAGGCCCTGCCCGCCCCTATCGAGAAAACCATCAGCAAGGCCAAGGGCCAGCCTAGGGAACCCCAGGTTTACACCCTTCCTCCATGCCGGGATGAGCTGACCAAGAACCAGGTGTCCCTGTGGTGTCTGGTCAAGGGCTTCTACCCCAGCGACATTGCCGTGGAATGGGAGAGCAATGGCCAGCCTGAGAACAACTACAAGACCACACCTCCTGTGCTGGACTCCGACGGATCATTCTTCCTGTACAGCAAGCTGACTGTGGACAAGAGCAGATGGCAGCAGGGCAACGTGTTCAGCTGCAGCGTGATGCACGAGGCCCTGCACAACCACTACACACAGAAGTCCCTGTCTCTGAGCCCTGGC

SEQ ID NO: 387 - protein, 259 aa, synthetic construct
  REGION 1..259: note = 10e8v4scFv
SELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVLGGGGSGGSGSGGGGSASGSGEVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSS

SEQ ID NO: 388 - protein, 1473 aa, synthetic construct
  REGION 1..1473: note = 10e8v4scFv
AGCGAACTGACCCAAGATCCTGCCGTGTCTGTGGCCCTGAAGCAGACCGTGACCATCACCTGTAGAGGCGACAGCCTGAGAAGCCACTACGCCAGCTGGTATCAGAAGAAGCCTGGACAGGCTCCCGTGCTGCTGTTCTACGGCAAGAACAACAGACCCAGCGGCATCCCCGATAGATTTTCTGGCAGCGCCAGCGGCAATAGAGCCAGCCTGACAATTACTGGCGCCCAGGCCGAAGATGAGGCCGACTACTACTGCAGCAGCAGAGACAAGAGCGGCAGCAGACTGTCCGTTTTTGGCGGAGGCACCAAGCTGACCGTGCTGGGCGGCGGAGGAAGCGGCGGATCTGGATCTGGTGGCGGAGGATCTGCTTCTGGCTCTGGAGAAGTTCGGCTGGTGGAATCTGGCGGCGGACTTGTGAAACCTGGCGGCTCTCTGAGACTGAGCTGTAGCGCCTCCGGCTTCGACTTCGACAATGCCTGGATGACCTGGGTCCGACAGCCTCCTGGAAAAGGCCTGGAATGGGTCGGAAGAATCACAGGCCCTGGCGAAGGCTGGAGTGTGGATTATGCCGAGAGCGTGAAGGGCAGATTCACCATCAGCCGGGACAACACCAAGAACACCCTGTACCTGGAAATGAACAACGTGCGGACCGAGGATACCGGCTACTACTTCTGTGCCCGGACCGGCAAGTACTACGACTTTTGGAGCGGCTACCCTCCTGGCGAGGAATACTTTCAGGATTGGGGCCAGGGCACCCTGGTCATCGTTTCTTCTGCTAGCGGAGGTTCCGGAGATAAGACCCACACATGTCCTCCATGTCCTGCTCCAGAACTGCTGGGCGGACCTTCCGTGTTTCTGTTCCCTCCAAAGCCTAAGGACACCCTGATGATCAGCAGGACCCCTGAAGTGACCTGCGTGGTGGTGGATGTGTCTCACGAGGACCCAGAAGTGAAGTTCAATTGGTACGTGGACGGCGTGGAAGTGCACAACGCCAAGACCAAGCCTAGAGAGGAACAGTACAACAGCACCTACAGAGTGGTGTCCGTGCTGACAGTGCTGCACCAGGATTGGCTGAACGGCAAAGAGTACAAGTGCAAGGTGTCCAACAAGGCCCTGCCCGCCCCTATCGAGAAAACCATCAGCAAGGCCAAGGGCCAGCCTAGGGAACCCCAGGTTTACACCCTTCCTCCATGCCGGGATGAGCTGACCAAGAACCAGGTGTCCCTGTGGTGTCTGGTCAAGGGCTTCTACCCCAGCGACATTGCCGTGGAATGGGAGAGCAATGGCCAGCCTGAGAACAACTACAAGACCACACCTCCTGTGCTGGACTCCGACGGATCATTCTTCCTGTACAGCAAGCTGACTGTGGACAAGAGCAGATGGCAGCAGGGCAACGTGTTCAGCTGCAGCGTGATGCACGAGGCCCTGCACAACCACTACACACAGAAGTCCCTGTCTCTGAGCCCTGGC

SEQ ID NO: 389 - protein, 226 aa, synthetic construct
  REGION 1..226: note = Fc - 1
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 390 - protein, 226 aa, synthetic construct; identical to SEQ ID NO: 279
  REGION 1..226: note = Fc - 2

SEQ ID NO: 391 - protein, 226 aa, synthetic construct
  REGION 1..226: note = Fc  3
DTTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 392 - protein, 226 aa, synthetic construct
  REGION 1..226: note = Fc  4
DTTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 393 - protein, 226 aa, synthetic construct
  REGION 1..226: note = Fc  5
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 394 - protein, 222 aa, synthetic construct
  REGION 1..222: note = Fc  6
TCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 395 - protein, 106 aa, synthetic construct [sequence omitted]

SEQ ID NO: 396 - protein, 120 aa, synthetic construct
  REGION 1..120: note = Fc  8
CPPCPAPEAAGGPSGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 397 - protein, 125 aa, synthetic construct
  REGION 1..125: note = Fc  9
DKTHTCPPCPAPEAAGGPSGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 398 - protein, 106 aa, synthetic construct
  REGION 1..106: note = Fc  10
GQPREPQVYTLPPCRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 399 - protein, 106 aa, synthetic construct
  REGION 1..106: note = Fc  11
GQPREPQVCTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 400 - protein, 226 aa, synthetic construct
  REGION 1..226: note = Fc - 12
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 401 - protein, 226 aa, synthetic construct
  REGION 1..226: note = Fc - 13
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 402 - protein, 227 aa, synthetic construct
  REGION 1..227: note = Fc  14
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 403 - protein, 112 aa, synthetic construct
  REGION 1..112: note = CH1  1
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 404 - protein, 103 aa, synthetic construct
  REGION 1..103: note = CH1  2
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSS

SEQ ID NO: 405 - protein, 105 aa, synthetic construct
  REGION 1..105: note = CH1  3
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKTPLG

SEQ ID NO: 406 - protein, 103 aa, synthetic construct
  REGION 1..103: note = CH1  4
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 407 - protein, 115 aa, synthetic construct
  REGION 1..115: note = CH1 - 5
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKTPLGDTTHTCPPCP

SEQ ID NO: 408 - protein, 120 aa, synthetic construct
  REGION 1..120: note = CH2  1
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAK

SEQ ID NO: 409 - protein, 120 aa, synthetic construct
  REGION 1..120: note = CH2  2
DTTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAK

SEQ ID NO: 410 - protein, 116 aa, synthetic construct
  REGION 1..116: note = CH2  3
TCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAK

SEQ ID NO: 411 - protein, 14 aa, synthetic construct
  REGION 1..14: note = CH2  4
CPPCPAPEAAGGPS

SEQ ID NO: 412 - protein, 19 aa, synthetic construct
  REGION 1..19: note = CH2  5
DKTHTCPPCPAPEAAGGPS

SEQ ID NO: 413 - protein, 120 aa, synthetic construct
  REGION 1..120: note = CH2 - 6
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 414 - protein, 106 aa, synthetic construct [sequence omitted]

SEQ ID NO: 415 - protein, 120 aa, synthetic construct; identical to SEQ ID NO: 396
  REGION 1..120: note = CH3  2

SEQ ID NO: 416 - protein, 106 aa, synthetic construct; identical to SEQ ID NO: 399
  REGION 1..106: note = CH3  3

SEQ ID NO: 417 - protein, 106 aa, synthetic construct; identical to SEQ ID NO: 398
  REGION 1..106: note = CH3  4

SEQ ID NO: 418 - protein, 107 aa, synthetic construct [sequence omitted]

SEQ ID NO: 419 - protein, 116 aa, synthetic construct
  REGION 1..116: note = CL - 2
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPC

SEQ ID NO: 420 - protein, 9 aa, synthetic construct
  REGION 1..9: note = Epitope sequence
GILGFVFTL

SEQ ID NO: 421 - protein, 14 aa, synthetic construct
  REGION 1..14: note = Epitope sequence
PKYVKFQNTLKLAT

SEQ ID NO: 422 - protein, 9 aa, synthetic construct
  REGION 1..9: note = Epitope sequence
SRYWAIRTR

SEQ ID NO: 423 - protein, 9 aa, synthetic construct
  REGION 1..9: note = Epitope sequence
CTELKLSDY

SEQ ID NO: 424 - protein, 9 aa, synthetic construct
  REGION 1..9: note = Epitope sequence
ELRSRYWAI

SEQ ID NO: 425 - protein, 9 aa, synthetic construct
  REGION 1..9: note = Epitope sequence
ILRGSVAHK

SEQ ID NO: 426 - protein, 9 aa, synthetic construct
  REGION 1..9: note = Epitope sequence
VSDGGPNLY

SEQ ID NO: 427 - protein, 9 aa, synthetic construct
  REGION 1..9: note = Epitope sequence
FMYSEFHFI

SEQ ID NO: 428 - protein, 9 aa, synthetic construct
  REGION 1..9: note = Epitope sequence
AIMDKNIIL

SEQ ID NO: 429 - protein, 9 aa, synthetic construct
  REGION 1..9: note = Epitope sequence
NMLSTVLGV

SEQ ID NO: 430 - protein, 9 aa, synthetic construct
  REGION 1..9: note = Epitope sequence
FLKDVMESM

SEQ ID NO: 431 - protein, 9 aa, synthetic construct
  REGION 1..9: note = Epitope sequence
LPFEKSTVM

SEQ ID NO: 432 - protein, 9 aa, synthetic construct
  REGION 1..9: note = Epitope sequence
FVRQCFNPM

SEQ ID NO: 433 - protein, 10 aa, synthetic construct
  REGION 1..10: note = Epitope sequence
KLGEFYNQMM

SEQ ID NO: 434 - protein, 15 aa, synthetic construct
  REGION 1..15: note = Epitope sequence
AVLLSNEGIINSEDE

SEQ ID NO: 435 - protein, 16 aa, synthetic construct
  REGION 1..16: note = Epitope sequence
AVLLSNEGIINSEDEH

SEQ ID NO: 436 - protein, 8 aa, synthetic construct
  REGION 1..8: note = Epitope sequence
AYDQSGRL

SEQ ID NO: 437 - protein, 9 aa, synthetic construct
  REGION 1..9: note = Epitope sequence
AYDQSGRLV

SEQ ID NO: 438 - protein, 10 aa, synthetic construct
  REGION 1..10: note = Epitope sequence
FPIMHDRTKI

SEQ ID NO: 439 - protein, 15 aa, synthetic construct
  REGION 1..15: note = Epitope sequence
ITKNLNSLSELEVKN

SEQ ID NO: 440 - protein, 17 aa, synthetic construct
  REGION 1..17: note = Epitope sequence
ITKNLNSLSELEVKNLQ

SEQ ID NO: 441 - protein, 16 aa, synthetic construct
  REGION 1..16: note = Epitope sequence
LAVLLSNEGIINSEDE

SEQ ID NO: 442 - protein, 17 aa, synthetic construct
  REGION 1..17: note = Epitope sequence
LAVLLSNEGIINSEDEH

SEQ ID NO: 443 - protein, 9 aa, synthetic construct
  REGION 1..9: note = Epitope sequence
LPQSGRIVV

SEQ ID NO: 444 - protein, 9 aa, synthetic construct
  REGION 1..9: note = Epitope sequence
SYIGSINNI

SEQ ID NO: 445 - protein, 9 aa, synthetic construct
  REGION 1..9: note = Epitope sequence
NAITNAKII

SEQ ID NO: 446 - protein, 9 aa, synthetic construct
  REGION 1..9: note = Epitope sequence
KYKNAVTEL

SEQ ID NO: 447 - protein, 24 aa, synthetic construct
  REGION 1..24: note = Epitope sequence
NSELLSLINDMPITNDQKKLMSNN

SEQ ID NO: 448 - protein, 9 aa, synthetic construct
  REGION 1..9: note = Epitope sequence
NPKASLLSL

SEQ ID NO: 449 - protein, 9 aa, synthetic construct
  REGION 1..9: note = Epitope sequence
VYNTVISYI

SEQ ID NO: 450 - protein, 10 aa, synthetic construct
  REGION 1..10: note = Epitope sequence
TYMLTNSELL

SEQ ID NO: 451 - protein, 13 aa, synthetic construct
  REGION 1..13: note = Epitope sequence
WAICKRIPNKKPG

SEQ ID NO: 452 - protein, 11 aa, synthetic construct
  REGION 1..11: note = Epitope sequence
KNRGIIKTFSN

SEQ ID NO: 453 - protein, 6 aa, synthetic construct
  REGION 1..6: note = Epitope sequence
TLNPTI

SEQ ID NO: 454 - protein, 12 aa, synthetic construct
  REGION 1..12: note = Epitope sequence
ATLVVNRIRGGF

SEQ ID NO: 455 - protein, 6 aa, synthetic construct
  REGION 1..6: note = Epitope sequence
LNPTIA

SEQ ID NO: 456 - protein, 12 aa, synthetic construct
  REGION 1..12: note = Epitope sequence
SANNDAEIGNLI

SEQ ID NO: 457 - protein, 16 aa, synthetic construct
  REGION 1..16: note = Epitope sequence
PETISDPENRNKPSAE

SEQ ID NO: 458 - protein, 6 aa, synthetic construct
  REGION 1..6: note = Epitope sequence
AEGQLG

SEQ ID NO: 459 - protein, 9 aa, synthetic construct
  REGION 1..9: note = Epitope sequence
ARKLLLDNL

SEQ ID NO: 460 - protein, 9 aa, synthetic construct
  REGION 1..9: note = Epitope sequence
ASFVNPIYL

SEQ ID NO: 461 - protein, 12 aa, synthetic construct
  REGION 1..12: note = Epitope sequence
DVVDGMNFNRGY

SEQ ID NO: 462 - protein, 9 aa, synthetic construct
  REGION 1..9: note = Epitope sequence
NMFTPYIGV

SEQ ID NO: 463 - protein, 24 aa, synthetic construct
  REGION 1..24: note = Epitope sequence
NLVGLIGVKGSSIAADQLPNVGIT

SEQ ID NO: 464 - protein, 10 aa, synthetic construct
  REGION 1..10: note = Epitope sequence
SGPSNTPPEI

SEQ ID NO: 465 - protein, 9 aa, synthetic construct
  REGION 1..9: note = Epitope sequence
TDLGQNLLY

SEQ ID NO: 466 - protein, 10 aa, synthetic construct
  REGION 1..10: note = Epitope sequence
LTDLGQNLLY

SEQ ID NO: 467 - protein, 9 aa, synthetic construct
  REGION 1..9: note = Epitope sequence
FALSNAEDL

SEQ ID NO: 468 - protein, 15 aa, synthetic construct
  REGION 1..15: note = Epitope sequence
DEPTLLYVLFEVFDV

SEQ ID NO: 469 - protein, 9 aa, synthetic construct
  REGION 1..9: note = Epitope sequence
KYSPSNVKI

SEQ ID NO: 470 - protein, 9 aa, synthetic construct
  REGION 1..9: note = Epitope sequence
MPNRNYIAF

SEQ ID NO: 471 - protein, 15 aa, synthetic construct
  REGION 1..15: note = Epitope sequence
VDCYINLGARWSLDY

SEQ ID NO: 472 - protein, 9 aa, synthetic construct
  REGION 1..9: note = Epitope sequence
VNIRNCCYI

SEQ ID NO: 473 - protein, 30 aa, synthetic construct
  REGION 1..30: note = Epitope sequence
RNFQPMSRQVVDDTKYKDYQQVGILHQHNN

SEQ ID NO: 474 - protein, 9 aa, synthetic construct
  REGION 1..9: note = Epitope sequence
LPKLTPFAL

SEQ ID NO: 475 - protein, 15 aa, synthetic construct
  REGION 1..15: note = Epitope sequence
FQRPTISSNSHAIFR

SEQ ID NO: 476 - protein, 10 aa, synthetic construct
  REGION 1..10: note = Epitope sequence
SGPSNTPPEI

SEQ ID NO: 477 - protein, 9 aa, synthetic construct
  REGION 1..9: note = Epitope sequence
TDLGQNLLY

SEQ ID NO: 478 - protein, 10 aa, synthetic construct
  REGION 1..10: note = Epitope sequence
LTDLGQNLLY

SEQ ID NO: 479 - protein, 9 aa, synthetic construct
  REGION 1..9: note = Epitope sequence
FALSNAEDL

SEQ ID NO: 480 - protein, 15 aa, synthetic construct
  REGION 1..15: note = Epitope sequence
DEPTLLYVLFEVFDV

SEQ ID NO: 481 - protein, 9 aa, synthetic construct
  REGION 1..9: note = Epitope sequence
KYSPSNVKI

SEQ ID NO: 482 - protein, 10 aa, synthetic construct
  REGION 1..10: note = Epitope sequence
MPNRPNYIAF

SEQ ID NO: 483 - protein, 15 aa, synthetic construct
  REGION 1..15: note = Epitope sequence
VDCYINLGARWSLDY

SEQ ID NO: 484 - protein, 9 aa, synthetic construct
  REGION 1..9: note = Epitope sequence
LPKLTPFAL

SEQ ID NO: 485 - protein, 15 aa, synthetic construct
  REGION 1..15: note = Epitope sequence
FQRPTISSNSHAIFR

SEQ ID NO: 486 - protein, 21 aa, synthetic construct
  REGION 1..21: note = Epitope sequence
GKYTTETFATNSYTPSYIAQE

SEQ ID NO: 487 - protein, 10 aa, synthetic construct
  REGION 1..10: note = Epitope sequence
DYDDYNIGTT

SEQ ID NO: 488 - protein, 9 aa, synthetic construct
  REGION 1..9: note = Epitope sequence
KISGVFPNP

SEQ ID NO: 489 - protein, 10 aa, synthetic construct
  REGION 1..10: note = Epitope sequence
PLAPKESMFN

SEQ ID NO: 490 - protein, 33 aa, synthetic construct
  REGION 1..33: note = Epitope sequence
ETLLIEDDVSGQGKELGVNLNPAGPITADEQGL

SEQ ID NO: 491 - protein, 9 aa, synthetic construct
  REGION 1..9: note = Epitope sequence
NLVPMVATV

SEQ ID NO: 492 - protein, 9 aa, synthetic construct
  REGION 1..9: note = Epitope sequence
GLCTLVAML

SEQ ID NO: 493 - protein, 10 aa, synthetic construct
  REGION 1..10: note = Epitope sequence
TPRVTGGGAM

SEQ ID NO: 494 - protein, 8 aa, synthetic construct
  REGION 1..8: note = Epitope sequence
SSIEFARL

SEQ ID NO: 495 - protein, 9 aa, synthetic construct
  REGION 1..9: note = Epitope sequence
CLGGLLTMV

SEQ ID NO: 496 - protein, 9 aa, synthetic construct
  REGION 1..9: note = Epitope sequence
FLRGRAYGL

SEQ ID NO: 497 - protein, 9 aa, synthetic construct
  REGION 1..9: note = Epitope sequence
TPHFMPTNL

SEQ ID NO: 498 - protein, 8 aa, synthetic construct
  REGION 1..8: note = Epitope sequence
RAKFKQLL

SEQ ID NO: 499 - protein, 9 aa, synthetic construct
  REGION 1..9: note = Epitope sequence
RPPIFIRRL

SEQ ID NO: 500 - protein, 9 aa, synthetic construct
  REGION 1..9: note = Epitope sequence
VLEETSVML

SEQ ID NO: 501 - protein, 9 aa, synthetic construct
  REGION 1..9: note = Epitope sequence
IVTDFSVIK

SEQ ID NO: 502 - protein, 9 aa, synthetic construct
  REGION 1..9: note = Epitope sequence
IPSINVHHY

SEQ ID NO: 503 - protein, 9 aa, synthetic construct
  REGION 1..9: note = Epitope sequence
QYDPVAALF

SEQ ID NO: 504 - protein, 11 aa, synthetic construct
  REGION 1..11: note = Epitope sequence
HPVGEADYFEY

SEQ ID NO: 505 - protein, 9 aa, synthetic construct
  REGION 1..9: note = Epitope sequence
VTEHDTLLY

SEQ ID NO: 506 - protein, 9 aa, synthetic construct
  REGION 1..9: note = Epitope sequence
HGIRNASFI

SEQ ID NO: 507 - protein, 10 aa, synthetic construct
  REGION 1..10: note = Epitope sequence
AVFDRKSDAK

SEQ ID NO: 508 - protein, 9 aa, synthetic construct
  REGION 1..9: note = Epitope sequence
TPLHEQHGM

SEQ ID NO: 509 - protein, 11 aa, synthetic construct
  REGION 1..11: note = Epitope sequence
YSEHPTFTSQY

SEQ ID NO: 510 - protein, 9 aa, synthetic construct
  REGION 1..9: note = Epitope sequence
YVLDHLIVV

SEQ ID NO: 511 - protein, 9 aa, synthetic construct
  REGION 1..9: note = Epitope sequence
YLLEMLWRL

SEQ ID NO: 512 - protein, 9 aa, synthetic construct
  REGION 1..9: note = Epitope sequence
FLYALALLL

SEQ ID NO: 513 - protein, 9 aa, synthetic construct
  REGION 1..9: note = Epitope sequence
QAKWRLQTL

SEQ ID NO: 514 - protein, 9 aa, synthetic construct
  REGION 1..9: note = Epitope sequence
ELRRKMMYM

SEQ ID NO: 515 - protein, 11 aa, synthetic construct
  REGION 1..11: note = Epitope sequence
RPHERNGFTVL

SEQ ID NO: 516 - protein, 8 aa, synthetic construct
  REGION 1..8: note = Epitope sequence
SSIEFARL

SEQ ID NO: 517 - protein, 8 aa, synthetic construct
  REGION 1..8: note = Epitope sequence
QTFDRGRL

SEQ ID NO: 518 - protein, 16 aa, synthetic construct
  REGION 1..16: note = Epitope sequence
SLKMADPNRFRGKDLP

SEQ ID NO: 519 - protein, 34 aa, synthetic construct
  REGION 1..34: note = Epitope sequence
QPPSLPITVYYAVLERACTSVLLNAPSEAPQIVR

SEQ ID NO: 520 - protein, 9 aa, synthetic construct
  REGION 1..9: note = Epitope sequence
RLNELLAYV

SEQ ID NO: 521 - protein, 9 aa, synthetic construct
  REGION 1..9: note = Epitope sequence
RMLGDVMAV

SEQ ID NO: 522 - protein, 23 aa, synthetic construct
  REGION 1..23: note = Epitope sequence
KYALADASLKMADPNRFRGKDLP

SEQ ID NO: 523 - protein, 9 aa, synthetic construct
  REGION 1..9: note = Epitope sequence
SLPITVTTA

SEQ ID NO: 524 - protein, 8 aa, synthetic construct
  REGION 1..8: note = Epitope sequence
DPEDSALL

SEQ ID NO: 525 - protein, 9 aa, synthetic construct
  REGION 1..9: note = Epitope sequence
DYATLGVGV

SEQ ID NO: 526 - protein, 9 aa, synthetic construct
  REGION 1..9: note = Epitope sequence
RPRGEVRFL

SEQ ID NO: 527 - protein, 8 aa, synthetic construct
  REGION 1..8: note = Epitope sequence
SSIEFARL

SEQ ID NO: 528 - protein, 15 aa, synthetic construct
  REGION 1..15: note = Epitope sequence
EEVDMTPADALDDFD

SEQ ID NO: 529 - protein, 9 aa, synthetic construct
  REGION 1..9: note = Epitope sequence
GLADTVVAC

SEQ ID NO: 530 - protein, 9 aa, synthetic construct
  REGION 1..9: note = Epitope sequence
ASDSLNNEY

SEQ ID NO: 531 - protein, 13 aa, synthetic construct
  REGION 1..13: note = Epitope sequence
DFEFEQMFTDAMG

SEQ ID NO: 532 - protein, 10 aa, synthetic construct
  REGION 1..10: note = Epitope sequence
EVDMTPADAL

SEQ ID NO: 533 - protein, 18 aa, synthetic construct
  REGION 1..18: note = Epitope sequence
PEEFEGAGDGEPPEDDDS

SEQ ID NO: 534 - protein, 9 aa, synthetic construct
  REGION 1..9: note = Epitope sequence
FLWEDQTLL

SEQ ID NO: 535 - protein, 10 aa, synthetic construct
  REGION 1..10: note = Epitope sequence
FLVDAIVRVA

SEQ ID NO: 536 - protein, 20 aa, synthetic construct
  REGION 1..20: note = Epitope sequence
GPADAPPGSPAPPPPEHRGG

SEQ ID NO: 537 - protein, 9 aa, synthetic construct
  REGION 1..9: note = Epitope sequence
GPHETITAL

SEQ ID NO: 538 - protein, 23 aa, synthetic construct
  REGION 1..23: note = Epitope sequence
KYALADPSLKMADPNRFRGKNLP

SEQ ID NO: 539 - protein, 11 aa, synthetic construct
  REGION 1..11: note = Epitope sequence
NNYGSTIEGLL

SEQ ID NO: 540 - protein, 20 aa, synthetic construct
  REGION 1..20: note = Epitope sequence
PEEFEGAGDGEPPEDDDSAT

SEQ ID NO: 541 - protein, 20 aa, synthetic construct
  REGION 1..20: note = Epitope sequence
PPLYATGRLSQAQLMPSPPM

SEQ ID NO: 542 - protein, 12 aa, synthetic construct
  REGION 1..12: note = Epitope sequence
TQPELVPEDPED

SEQ ID NO: 543 - protein, 15 aa, synthetic construct
  REGION 1..15: note = Epitope sequence
YTSTLLPPELSDTTN

SEQ ID NO: 544 - protein, 20 aa, synthetic construct
  REGION 1..20: note = Epitope sequence
DPSLKMADPNRFRGKNLPVL

SEQ ID NO: 545 - protein, 20 aa, synthetic construct
  REGION 1..20: note = Epitope sequence
PELVPEDPEDSALLEDPAGT

SEQ ID NO: 546 - protein, 9 aa, synthetic construct
  REGION 1..9: note = Epitope sequence
HGPSLYRTF

SEQ ID NO: 547 - protein, 13 aa, synthetic construct
  REGION 1..13: note = Epitope sequence
NKRVFCAAVGRLA

SEQ ID NO: 548 - protein, 13 aa, synthetic construct
  REGION 1..13: note = Epitope sequence
PMRARPRGEVRFL

SEQ ID NO: 549 - protein, 9 aa, synthetic construct
  REGION 1..9: note = Epitope sequence
VFCAAVGRL

SEQ ID NO: 550 - protein, 15 aa, synthetic construct
  REGION 1..15: note = Epitope sequence
LGNRLCGPATAAWAG

SEQ ID NO: 551 - protein, 9 aa, synthetic construct
  REGION 1..9: note = Epitope sequence
NLVPMVATV

SEQ ID NO: 552 - protein, 9 aa, synthetic construct
  REGION 1..9: note = Epitope sequence
TMYGGISLL

SEQ ID NO: 553 - protein, 9 aa, synthetic construct
  REGION 1..9: note = Epitope sequence
VLEETSVML

SEQ ID NO: 554 - protein, 10 aa, synthetic construct
  REGION 1..10: note = Epitope sequence
LDPHAFHLLL

SEQ ID NO: 555 - protein, 9 aa, synthetic construct
  REGION 1..9: note = Epitope sequence
RIFAELEGV

SEQ ID NO: 556 - protein, 11 aa, synthetic construct
  REGION 1..11: note = Epitope sequence
RPHERNGFTVL

SEQ ID NO: 557 - protein, 9 aa, synthetic construct
  REGION 1..9: note = Epitope sequence
VFPTKDVAL

SEQ ID NO: 558 - protein, 9 aa, synthetic construct
  REGION 1..9: note = Epitope sequence
VLAELVKQI

SEQ ID NO: 559 - protein, 9 aa, synthetic construct
  REGION 1..9: note = Epitope sequence
VLPHETRLL

SEQ ID NO: 560 - protein, 13 aa, synthetic construct
  REGION 1..13: note = Epitope sequence
KRLDVCRAKMGYM

SEQ ID NO: 561 - protein, 18 aa, synthetic construct
  REGION 1..18: note = Epitope sequence
GGGAMAGASTSAGRKRKS

SEQ ID NO: 562 - protein, 9 aa, synthetic construct
  REGION 1..9: note = Epitope sequence
AALFFFDID

SEQ ID NO: 563 - protein, 15 aa, synthetic construct
  REGION 1..15: note = Epitope sequence
AGILARNLVPMVATV

SEQ ID NO: 564 - protein, 10 aa, synthetic construct
  REGION 1..10: note = Epitope sequence
ALFFFDIDLL

SEQ ID NO: 565 - protein, 15 aa, synthetic construct
  REGION 1..15: note = Epitope sequence
ANETIYNTTLKYGDV

SEQ ID NO: 566 - protein, 15 aa, synthetic construct
  REGION 1..15: note = Epitope sequence
ARAKKDELRRKMMYM

SEQ ID NO: 567 - protein, 15 aa, synthetic construct
  REGION 1..15: note = Epitope sequence
ARNLVPMVATVQGQN

SEQ ID NO: 568 - protein, 20 aa, synthetic construct
  REGION 1..20: note = Epitope sequence
ASTAAPPYTNEQAYQMLLAL

SEQ ID NO: 569 - protein, 9 aa, synthetic construct
  REGION 1..9: note = Epitope sequence
AVGGAVASV

SEQ ID NO: 570 - protein, 10 aa, synthetic construct
  REGION 1..10: note = Epitope sequence
DEEEAIVAYT

SEQ ID NO: 571 - protein, 11 aa, synthetic construct
  REGION 1..11: note = Epitope sequence
DEEEAIVAYTL

SEQ ID NO: 572 - protein, 9 aa, synthetic construct
  REGION 1..9: note = Epitope sequence
DPVAALFFF

SEQ ID NO: 573 - protein, 9 aa, synthetic construct
  REGION 1..9: note = Epitope sequence
EEAIVAYTL

SEQ ID NO: 574 - protein, 18 aa, synthetic construct
  REGION 1..18: note = Epitope sequence
EECQLPSLKIFIAGNSAY

SEQ ID NO: 575 - protein, 10 aa, synthetic construct
  REGION 1..10: note = Epitope sequence
EEEAIVAYTL

SEQ ID NO: 576 - protein, 8 aa, synthetic construct
  REGION 1..8: note = Epitope sequence
TSYKFESV

SEQ ID NO: 577 - protein, 8 aa, synthetic construct
  REGION 1..8: note = Epitope sequence
ITYRFYLI

SEQ ID NO: 578 - protein, 9 aa, synthetic construct
  REGION 1..9: note = Epitope sequence
ILDDNLYKV

SEQ ID NO: 579 - protein, 9 aa, synthetic construct
  REGION 1..9: note = Epitope sequence
KVDDTFYYV

SEQ ID NO: 580 - protein, 9 aa, synthetic construct
  REGION 1..9: note = Epitope sequence
AAFEFINSL

SEQ ID NO: 581 - protein, 8 aa, synthetic construct
  REGION 1..8: note = Epitope sequence
KSYNYMLL

SEQ ID NO: 582 - protein, 9 aa, synthetic construct
  REGION 1..9: note = Epitope sequence
MPAYIRNTL

SEQ ID NO: 583 - protein, 9 aa, synthetic construct
  REGION 1..9: note = Epitope sequence
RVYEALYYV

SEQ ID NO: 584 - protein, 9 aa, synthetic construct
  REGION 1..9: note = Epitope sequence
IGMFNLTFI

SEQ ID NO: 585 - protein, 9 aa, synthetic construct
  REGION 1..9: note = Epitope sequence
SLSAYIIRV

SEQ ID NO: 586 - protein, 9 aa, synthetic construct
  REGION 1..9: note = Epitope sequence
LMYDIINSV

SEQ ID NO: 587 - protein, 9 aa, synthetic construct
  REGION 1..9: note = Epitope sequence
RLYDYFTRV

SEQ ID NO: 588 - protein, 10 aa, synthetic construct
  REGION 1..10: note = Epitope sequence
YSLPNAGDVI

SEQ ID NO: 589 - protein, 9 aa, synthetic construct
  REGION 1..9: note = Epitope sequence
YSQVNKRYI

SEQ ID NO: 590 - protein, 9 aa, synthetic construct
  REGION 1..9: note = Epitope sequence
VSLDYINTM

SEQ ID NO: 591 - protein, 9 aa, synthetic construct
  REGION 1..9: note = Epitope sequence
TLPEVISTI

SEQ ID NO: 592 - protein, 9 aa, synthetic construct
  REGION 1..9: note = Epitope sequence
FLTSVINRV

SEQ ID NO: 593 - protein, 9 aa, synthetic construct
  REGION 1..9: note = Epitope sequence
GFFDFVNFV

SEQ ID NO: 594 - protein, 9 aa, synthetic construct
  REGION 1..9: note = Epitope sequence
VLYDEFVTI

SEQ ID NO: 595 - protein, 9 aa, synthetic construct
  REGION 1..9: note = Epitope sequence
FPYEGGKVF

SEQ ID NO: 596 - protein, 9 aa, synthetic construct
  REGION 1..9: note = Epitope sequence
LMDENTYAM

SEQ ID NO: 597 - protein, 10 aa, synthetic construct
  REGION 1..10: note = Epitope sequence
NLFDIPLLTV

SEQ ID NO: 598 - protein, 9 aa, synthetic construct
  REGION 1..9: note = Epitope sequence
VGPSNSPTF

SEQ ID NO: 599 - protein, 9 aa, synthetic construct
  REGION 1..9: note = Epitope sequence
YAPVSPIVI

SEQ ID NO: 600 - protein, 9 aa, synthetic construct
  REGION 1..9: note = Epitope sequence
HVDGKILFV

SEQ ID NO: 601 - protein, 8 aa, synthetic construct
  REGION 1..8: note = Epitope sequence
AAFEFRDL

SEQ ID NO: 602 - protein, 8 aa, synthetic construct
  REGION 1..8: note = Epitope sequence
AIIKYTDL

SEQ ID NO: 603 - protein, 8 aa, synthetic construct
  REGION 1..8: note = Epitope sequence
AIYAFRLT

SEQ ID NO: 604 - protein, 9 aa, synthetic construct
  REGION 1..9: note = Epitope sequence
AIYGFGVTF

SEQ ID NO: 605 - protein, 9 aa, synthetic construct
  REGION 1..9: note = Epitope sequence
ANVDFMEYV

SEQ ID NO: 606 - protein, 8 aa, synthetic construct
  REGION 1..8: note = Epitope sequence
EQFSFSNV

SEQ ID NO: 607 - protein, 15 aa, synthetic construct
  REGION 1..15: note = Epitope sequence
TYTFGEHKQEKDLEY

SEQ ID NO: 608 - protein, 15 aa, synthetic construct
  REGION 1..15: note = Epitope sequence
TEDSHPPYKQTQPGA

SEQ ID NO: 609 - protein, 15 aa, synthetic construct
  REGION 1..15: note = Epitope sequence
PESRESLAWQTATNP

SEQ ID NO: 610 - protein, 10 aa, synthetic construct
  REGION 1..10: note = Epitope sequence
FGEHKQEKDL

SEQ ID NO: 611 - protein, 15 aa, synthetic construct
  REGION 1..15: note = Epitope sequence
AGGTGTEDSHPPYKQ

SEQ ID NO: 612 - protein, 10 aa, synthetic construct
  REGION 1..10: note = Epitope sequence
FGEHKQEKDL

SEQ ID NO: 613 - protein, 15 aa, synthetic construct
  REGION 1..15: note = Epitope sequence
AGGTGTEDSHPPYKQ

SEQ ID NO: 614 - protein, 15 aa, synthetic construct
  REGION 1..15: note = Epitope sequence
FGEHKQEKDLEYGAC

SEQ ID NO: 615 - protein, 15 aa, synthetic construct
  REGION 1..15: note = Epitope sequence
HYRAHARDGVFDYYT

SEQ ID NO: 616 - protein, 5 aa, synthetic construct
  REGION 1..5: note = Epitope sequence
KQEDK

SEQ ID NO: 617 - protein, 15 aa, synthetic construct
  REGION 1..15: note = Epitope sequence
GDPIADMIDQTVNNQ

SEQ ID NO: 618 - protein, 15 aa, synthetic construct
  REGION 1..15: note = Epitope sequence
YPTFGEHLQANDLDY

SEQ ID NO: 619 - protein, 9 aa, synthetic construct
  REGION 1..9: note = Epitope sequence
LEGTTNPNT

SEQ ID NO: 620 - protein, 16 aa, synthetic construct
  REGION 1..16: note = Epitope sequence
VSSHRLDDTGEVPALQ

SEQ ID NO: 621 - protein, 10 aa, synthetic construct
  REGION 1..10: note = Epitope sequence
RIYMRMKHVR

SEQ ID NO: 622 - protein, 10 aa, synthetic construct
  REGION 1..10: note = Epitope sequence
TSKSKYPLVV

SEQ ID NO: 623 - protein, 15 aa, synthetic construct
  REGION 1..15: note = Epitope sequence
DGYPTFGEHKQEKDL

SEQ ID NO: 624 - protein, 9 aa, synthetic construct
  REGION 1..9: note = Epitope sequence
YMYAVSGAL

SEQ ID NO: 625 - protein, 12 aa, synthetic construct
  REGION 1..12: note = Epitope sequence
FWRGDLVFDFQV

SEQ ID NO: 626 - protein, 23 aa, synthetic construct
  REGION 1..23: note = Epitope sequence
MNMSKQGIFQTVGSGLDHILSLA

SEQ ID NO: 627 - protein, 15 aa, synthetic construct
  REGION 1..15: note = Epitope sequence
TVSTEQNVPDPQVGI

SEQ ID NO: 628 - protein, 20 aa, synthetic construct
  REGION 1..20: note = Epitope sequence
ASICQMFCFWRGDLVFDFQV

SEQ ID NO: 629 - protein, 20 aa, synthetic construct
  REGION 1..20: note = Epitope sequence
DHMSIYKFMGRSHFLCTFTF

SEQ ID NO: 630 - protein, 20 aa, synthetic construct
  REGION 1..20: note = Epitope sequence
FPELKPGESTHTSDHMSIYK

SEQ ID NO: 631 - protein, 724 aa, synthetic construct
  REGION 1..724: note = MX846 Chain 1
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGGSGGDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSGGSAGSGSGGGGSASGSGQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGSGGQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 632 - DNA, 2172 bp, synthetic construct
  misc_feature 1..2172: note = MX846 Chain 1
  source 1..2172: mol_type = other DNA
gacatcgtgatgacccagacacctctgagcctgcctgtgacacctggcgaacctgccagcatcagctgcagaagcagcaagagcctgctgcacagcaacggcatcacctacctgtactggtatctgcagaaacccggccagtctcctcagctgctgatctaccagatgagcaacctggtgtccggcgtgcccgatagattttctggcagcggctctggcaccgacttcaccctgaagattagcagagtggaagccgaggacgtgggcgtgtactactgtgcccagaacctggaactgccctacacctttggcggaggcaccaaggtggaaatcaagggcggatctggcggcgatattgtcatgactcagaccccactgtctctgcccgtgactccaggggaaccagcctccatctcttgcagatccagcaagtctctgctgcactctaatgggatcacatacctctattggtatctccaaaagcctgggcagagcccacagctcctcatctatcagatgtctaatctcgtgtctggggtgcccgacaggtttagcggttctggaagcggcacagatttcacactgaaaatctccagagtcgaggccgaagatgtgggagtctattattgcgcccagaatctcgagctgccttataccttcggaggcggaacaaaggtcgagatcaaaggttctggcggcagcgccggaagtggtagtggtggcggaggatctgcttctggctctggacaggttcagctggttcagtctggcgccgaagtgaagaaacctggcagcagcgtgaaggtgtcctgcaaggcctctggctacgccttcagctacagctggatcaactgggtccgacaggcccctggacaaggcttggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtccagcggcggaagcggaggacaggttcaactggtgcaaagcggagctgaagtgaaaaagcccggctcctccgtgaaagtgtcttgtaaagccagcggctacgctttctcctactcctggattaactgggttcgccaagctccaggccagggccttgagtggatgggacgaatttttcctggcgacggggatacagactacaatgggaagttcaaaggccgggtcacaatcacagccgataagtccacctccacagcttatatggaactgtctagcctgcgctccgaggatacagccgtctattactgtgctcgcaatgtctttgatggctattggctcgtctactggggacagggcacactcgtgacagtgtcctctgcttctggcggctccggagataagacccacacatgtcctccatgtcctgctccagaagctgctggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggaaccccaggtttacacccttcctccatgccgggatgagctgaccaagaaccaggtgtccctgtggtgtctcgtgaagggcttctaccccagcgacattgccgtggaatgggagagcaatggccagcctgagaacaactacaagacaacccctcctgtgctggacagcgacggctcattcttcctgtacagcaagctgacagtcgacaagtccagatggcagcagggcaacgtgttcagttgcagcgtgatgcacgaggccctgcacaaccactacacccagaagtccctgagcctgtctcctgga

SEQ ID NO: 633 - protein, 727 aa, synthetic construct
  REGION 1..727: note = MX846 Chain 1
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLGGSGGDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSGGSAGSGSGGGGSASGSGQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGSGGEVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 634 - protein, 2181 aa, synthetic construct
  REGION 1..2181: note = MX847 Chain 1
CAGGCCGTGGTTACACAAGAGCCTTCTCTGACCGTGTCTCCTGGCGGCACAGTGACACTGACATGTGGCAGTTCTACAGGCGCCGTGACCACCAGCAATTACGCCAACTGGGTGCAAGAGAAGCCAGGCCAGGCCTTCAGAGGACTGATCGGCGGCACAAACAAGAGAGCCCCTGGAACACCAGCCAGATTCAGCGGATCTCTGCTCGGAGGAAAGGCCGCACTGACACTGTCTGGTGCCCAGCCTGAAGATGAGGCCGAGTACTATTGCGCCCTGTGGTACAGCAACCTGTGGGTTTTCGGAGGCGGCACCAAGCTGACAGTGCTTGGCGGATCTGGCGGCGACATCGTGATGACCCAGACACCTCTGAGCCTGCCTGTGACACCTGGCGAACCTGCCAGCATCAGCTGCAGAAGCAGCAAGAGCCTGCTGCACAGCAACGGCATCACCTACCTGTACTGGTATCTGCAGAAACCCGGCCAGTCTCCTCAGCTGCTGATCTACCAGATGAGCAACCTGGTGTCCGGCGTGCCCGATAGATTTTCTGGCAGCGGCTCTGGCACCGACTTCACCCTGAAGATTAGCAGAGTGGAAGCCGAGGACGTGGGCGTGTACTACTGTGCCCAGAACCTGGAACTGCCCTACACCTTTGGCGGAGGCACCAAGGTGGAAATCAAAGGTTCTGGCGGCAGCGCCGGAAGTGGTAGTGGTGGCGGAGGATCTGCTTCTGGCTCTGGACAGGTTCAGCTGGTTCAGTCTGGCGCCGAAGTGAAGAAACCTGGCAGCAGCGTGAAGGTGTCCTGCAAGGCCTCTGGCTACGCCTTCAGCTACAGCTGGATCAACTGGGTCCGACAGGCCCCTGGACAAGGCTTGGAATGGATGGGCAGAATCTTCCCCGGCGACGGCGACACCGATTACAACGGCAAGTTCAAGGGCAGAGTGACCATCACCGCCGACAAGAGCACAAGCACCGCCTACATGGAACTGAGCAGCCTGAGAAGCGAGGACACCGCCGTGTACTACTGCGCCAGAAACGTGTTCGACGGCTACTGGCTGGTGTATTGGGGCCAGGGAACACTGGTCACAGTGTCCAGCGGCGGAAGCGGAGGAGAAGTGCAGCTGCTGGAATCTGGCGGAGGACTGGTTCAACCTGGCGGCTCTCTGAGACTGTCTTGTGCCGCCAGCGGCTTCACCTTTAGCACCTACGCCATGAACTGGGTCCGACAGGCCCCTGGCAAAGGCCTTGAATGGGTGTCCCGGATCAGAAGCAAGTACAACAACTACGCCACCTACTACGCCGACAGCGTGAAGGGCAGATTCACCATCAGCCGGGACGACAGCAAGAACACCCTGTACCTGCAGATGAACAGCCTGAGAGCCGAGGACACCGCCGTGTACTATTGTGTGCGGCACGGCAACTTCGGCAACAGCTATGTGTCTTGGTTTGCCTACTGGGGCCAGGGCACACTGGTCACAGTTAGCTCTGCTTCTGGAGGCTCCGGAGATAAGACCCACACATGTCCTCCATGTCCTGCTCCAGAGGCTGCTGGTGGCCCTTCCGTGTTTCTGTTCCCTCCAAAGCCTAAGGACACCCTGATGATCAGCAGGACCCCTGAAGTGACCTGCGTGGTGGTGGATGTGTCTCACGAGGACCCAGAAGTGAAGTTCAATTGGTACGTGGACGGCGTGGAAGTGCACAACGCCAAGACCAAGCCTAGAGAGGAACAGTACAACAGCACCTACAGAGTGGTGTCCGTGCTGACCGTGCTGCACCAGGATTGGCTGAACGGCAAAGAGTACAAGTGCAAGGTGTCCAACAAGGCCCTGGCCGCTCCTATCGAGAAAACCATCAGCAAGGCCAAGGGCCAGCCTCGCGAACCTCAAGTCTGTACACTGCCTCCTAGCCGGGACGAGCTGACCAAGAATCAGGTGTCACTGAGCTGCGCCGTGAAGGGCTTTTACCCCAGCGACATTGCCGTGGAATGGGAGAGCAATGGCCAGCCAGAGAACAACTACAAGACAACCCCTCCTGTGCTGGACAGCGACGGCTCATTTTTCCTGGTGTCCAAGCTGACAGTGGACAAGAGCAGATGGCAGCAGGGCAACGTGTTCAGCTGCAGCGTGATGCACGAGGCCCTGCACAACCACTACACCCAGAAAAGCCTGTCTCTGAGCCCTGGC

SEQ ID NO: 635 - protein, 724 aa, synthetic construct; identical to SEQ ID NO: 631
  REGION 1..724: note = MX847 Chain 1

SEQ ID NO: 636 - DNA, 2172 bp, synthetic construct; identical to SEQ ID NO: 632
  misc_feature 1..2172: note = MX847 Chain 1
  source 1..2172: mol_type = other DNA

SEQ ID NO: 637 - protein, 727 aa, synthetic construct
  REGION 1..727: note = MX847 Chain 1
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGGSGGQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLGSGGSAGSGSGGGGSASGSGEVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSGGSGGQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 638 - DNA, 2181 bp, synthetic construct
  misc_feature 1..2181: note = MX847 Chain 1
  source 1..2181: mol_type = other DNA
gacatcgtgatgacccagacacctctgagcctgcctgtgacacctggcgaacctgccagcatcagctgcagaagcagcaagagcctgctgcacagcaacggcatcacctacctgtactggtatctgcagaaacccggccagtctcctcagctgctgatctaccagatgagcaacctggtgtccggcgtgcccgatagattttctggcagcggctctggcaccgacttcaccctgaagattagcagagtggaagccgaggacgtgggcgtgtactactgtgcccagaacctggaactgccctacacctttggcggaggcaccaaggtggaaatcaaaggcggatctggcggccaggccgtggttacacaagagccttctctgaccgtgtctcctggcggcacagtgacactgacatgtggcagttctacaggcgccgtgaccaccagcaattacgccaactgggtgcaagagaagccaggccaggccttcagaggactgatcggcggcacaaacaagagagcccctggaacaccagccagattcagcggatctctgctcggaggaaaggccgcactgacactgtctggtgcccagcctgaagatgaggccgagtactattgcgccctgtggtacagcaacctgtgggttttcggaggcggcaccaagctgacagtgcttggttctggcggcagcgccggaagtggtagtggtggcggaggatctgcttctggctctggagaagtgcagctgctggaatctggcggaggactggttcaacctggcggctctctgagactgtcttgtgccgccagcggcttcacctttagcacctacgccatgaactgggtccgacaggcccctggcaaaggccttgaatgggtgtcccggatcagaagcaagtacaacaactacgccacctactacgccgacagcgtgaagggcagattcaccatcagccgggacgacagcaagaacaccctgtacctgcagatgaacagcctgagagccgaggacaccgccgtgtactattgtgtgcggcacggcaacttcggcaacagctatgtgtcttggtttgcctactggggccagggcacactggtcacagttagctctggcggaagcggaggacaggttcagctggttcagtctggcgccgaagtgaagaaacctggcagcagcgtgaaggtgtcctgcaaggcctctggctacgccttcagctacagctggatcaactgggtccgacaggcccctggacaaggcttggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtccagcgcttctggaggctccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 639 - protein, 722 aa, synthetic construct
  REGION 1..722: note = MX850 Chain 1
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGGSGGSYVLTQPPSVSVAPGQTARITCGGNNIGSKSVHWYQQPPGQAPVVVVYDDSDRPSGIPERFSGSNSGNTATLTISRVEAGDEAVYYCQVWDSSSDHVVFGGGTKLTVLGSGGSAGSGSGGGGSASGSGQLQLQESGPGLVKPSETLSLTCTVSGGSISSGSYFWGWIRQPPGKGLEWIGSIYYSGITYYNPSLKSRVTISVDTSKNQFSLKLSSVTAADTAVYYCARHDGAVAGLFDYWGQGTLVTVSSGGSGGQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 640 - DNA, 2166 bp, synthetic construct
  misc_feature 1..2166: note = MX850 Chain 1
  source 1..2166: mol_type = other DNA
gacatcgtgatgacccagacacctctgagcctgcctgtgacacctggcgaacctgccagcatcagctgcagaagcagcaagagcctgctgcacagcaacggcatcacctacctgtactggtatctgcagaaacccggccagtctcctcagctgctgatctaccagatgagcaacctggtgtccggcgtgcccgatagattttctggcagcggctctggcaccgacttcaccctgaagattagcagagtggaagccgaggacgtgggcgtgtactactgtgcccagaacctggaactgccctacacctttggcggaggcaccaaggtggaaatcaagggcggatctggcggcagctacgtgctgacacaacctccatctgtgtctgtggcccctggccagacagccagaattacatgcggcggcaacaacatcggcagcaagtccgtgcattggtatcagcagcctccaggacaggctcctgtggtggtggtgtacgacgacagcgatagacctagcggcatccccgagagattcagcggcagcaatagcggcaataccgccacactgaccatcagcagagttgaggctggcgacgaggccgtgtactattgccaagtgtgggacagcagcagcgatcacgtggtgtttggcggcggaacaaagctgacagtgctcggttctggcggcagcgccggaagtggtagtggtggcggaggatctgcttctggctctggacagctccagctgcaagagtctggccctggactggtcaagcctagcgagacactgagcctgacatgtaccgtgtctggcggcagcatctccagcggctcctatttctggggctggatcagacaacctcctggcaaaggcctggaatggatcggctccatctactacagcggaatcacctactacaaccccagcctgaagtccagagtgaccatctccgtggacaccagcaagaaccagttctccctgaagctgagcagcgtgacagccgccgataccgccgtctattactgcgccagacatgatggcgctgtggccggcctgtttgattattggggacagggcaccctggtcaccgttagcagcggcggaagcggaggacaggttcagctggttcagtctggcgccgaagtgaagaaacctggcagcagcgtgaaggtgtcctgcaaggcctctggctacgccttcagctacagctggatcaactgggtccgacaggcccctggacaaggcttggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtccagcgcttctggaggctccggagataagacccacacatgtcctccatgtcctgctccagaagctgctggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggaaccccaggtttacacccttcctccatgccgggatgagctgaccaagaaccaggtgtccctgtggtgtctcgtgaagggcttctaccccagcgacattgccgtggaatgggagagcaatggccagcctgagaacaactacaagacaacccctcctgtgctggacagcgacggctcattcttcctgtacagcaagctgacagtcgacaagtccagatggcagcagggcaacgtgttcagttgcagcgtgatgcacgaggccctgcacaaccactacacccagaagtccctgagcctgtctcctgga

SEQ ID NO: 641 - protein, 723 aa, synthetic construct
  REGION 1..723: note = MX850 Chain 1
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLGGSGGDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGSGGSAGSGSGGGGSASGSGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGSGGEVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 642 - DNA, 2169 bp, synthetic construct
  misc_feature 1..2169: note = MX850 Chain 1
  source 1..2169: mol_type = other DNA
caggccgtggttacacaagagccttctctgaccgtgtctcctggcggcacagtgacactgacatgtggcagttctacaggcgccgtgaccaccagcaattacgccaactgggtgcaagagaagccaggccaggccttcagaggactgatcggcggcacaaacaagagagcccctggaacaccagccagattcagcggatctctgctcggaggaaaggccgcactgacactgtctggtgcccagcctgaagatgaggccgagtactattgcgccctgtggtacagcaacctgtgggttttcggaggcggcaccaagctgacagtgcttggcggatctggcggcgacatccagatgacacagagccctagcagcctgtctgccagcgtgggagacagagtgaccatcacatgtcacgccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacttcgccacctactattgtcagcagggccagacatacccctacacctttggcggcggaacaaaggtggaaatcaagggttctggcggcagcgccggaagtggtagtggtggcggaggatctgcttctggctctggacaggttcagctggttcagtctggcgccgaagtgaagaaacctggcgcctctgtgaaggtgtcctgcaaggccagcggctacacctttaccagctactacatccactgggtccgacaggcccctggacaaggactggaatggatcggcagcatctaccccggcaacgtgaacaccaactacaacgagaagttcaaggaccgggccacactgaccgtggacacctctatcagcaccgcctacatggaactgagccggctgagatccgatgataccgccgtgtacttctgcaccagaagccactacggcctggactggaacttcgatgtgtggggccagggcaccaccgtgacagtttcttctggcggaagcggaggagaagtgcagctgctggaatctggcggaggactggttcaacctggcggctctctgagactgtcttgtgccgccagcggcttcacctttagcacctacgccatgaactgggtccgacaggcccctggcaaaggccttgaatgggtgtcccggatcagaagcaagtacaacaactacgccacctactacgccgacagcgtgaagggcagattcaccatcagccgggacgacagcaagaacaccctgtacctgcagatgaacagcctgagagccgaggacaccgccgtgtactattgtgtgcggcacggcaacttcggcaacagctatgtgtcttggtttgcctactggggccagggcacactggtcacagttagctctgcttctggaggctccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 643 - protein, 722 aa, synthetic construct; identical to SEQ ID NO: 639
  REGION 1..722: note = MX851 Chain 1

SEQ ID NO: 644 - DNA, 2166 bp, synthetic construct; identical to SEQ ID NO: 640
  misc_feature 1..2166: note = MX851 Chain 1
  source 1..2166: mol_type = other DNA

SEQ ID NO: 645 - protein, 723 aa, synthetic construct
  REGION 1..723: note = MX851 Chain 1
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKGGSGGQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLGSGGSAGSGSGGGGSASGSGEVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSGGSGGQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 646 - DNA, 2169 bp, synthetic construct
  misc_feature 1..2169: note = MX851 Chain 1
  source 1..2169: mol_type = other DNA
gacatccagatgacacagagccctagcagcctgtctgccagcgtgggagacagagtgaccatcacatgtcacgccagccagaacatctacgtgtggctgaactggtatcagcagaagcccggcaaggcccctaagctgctgatctacaaggccagcaatctgcacaccggcgtgcccagcagattttctggctctggcagcggcaccgacttcaccctgaccatatctagcctgcagcctgaggacttcgccacctactattgtcagcagggccagacatacccctacacctttggcggcggaacaaaggtggaaatcaagggcggatctggcggccaggccgtggttacacaagagccttctctgaccgtgtctcctggcggcacagtgacactgacatgtggcagttctacaggcgccgtgaccaccagcaattacgccaactgggtgcaagagaagccaggccaggccttcagaggactgatcggcggcacaaacaagagagcccctggaacaccagccagattcagcggatctctgctcggaggaaaggccgcactgacactgtctggtgcccagcctgaagatgaggccgagtactattgcgccctgtggtacagcaacctgtgggttttcggaggcggcaccaagctgacagtgcttggttctggcggcagcgccggaagtggtagtggtggcggaggatctgcttctggctctggagaagtgcagctgctggaatctggcggaggactggttcaacctggcggctctctgagactgtcttgtgccgccagcggcttcacctttagcacctacgccatgaactgggtccgacaggcccctggcaaaggccttgaatgggtgtcccggatcagaagcaagtacaacaactacgccacctactacgccgacagcgtgaagggcagattcaccatcagccgggacgacagcaagaacaccctgtacctgcagatgaacagcctgagagccgaggacaccgccgtgtactattgtgtgcggcacggcaacttcggcaacagctatgtgtcttggtttgcctactggggccagggcacactggtcacagttagctctggcggaagcggaggacaggttcagctggttcagtctggcgccgaagtgaagaaacctggcgcctctgtgaaggtgtcctgcaaggccagcggctacacctttaccagctactacatccactgggtccgacaggcccctggacaaggactggaatggatcggcagcatctaccccggcaacgtgaacaccaactacaacgagaagttcaaggaccgggccacactgaccgtggacacctctatcagcaccgcctacatggaactgagccggctgagatccgatgataccgccgtgtacttctgcaccagaagccactacggcctggactggaacttcgatgtgtggggccagggcaccaccgtgacagtttcttctgcttctggaggctccggagataagacccacacatgtcctccatgtcctgctccagaggctgctggtggcccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctcgcgaacctcaagtctgtacactgcctcctagccgggacgagctgaccaagaatcaggtgtcactgagctgcgccgtgaagggcttttaccccagcgacattgccgtggaatgggagagcaatggccagccagagaacaactacaagacaacccctcctgtgctggacagcgacggctcatttttcctggtgtccaagctgacagtggacaagagcagatggcagcagggcaacgtgttcagctgcagcgtgatgcacgaggccctgcacaaccactacacccagaaaagcctgtctctgagccctggc

SEQ ID NO: 647 - protein, 722 aa, synthetic construct
  REGION 1..722: note = MX852 Chain 1
SYVLTQPPSVSVAPGQTARITCGGNNIGSKSVHWYQQPPGQAPVVVVYDDSDRPSGIPERFSGSNSGNTATLTISRVEAGDEAVYYCQVWDSSSDHVVFGGGTKLTVLGGSGGDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSGGSAGSGSGGGGSASGSGQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGSGGQLQLQESGPGLVKPSETLSLTCTVSGGSISSGSYFWGWIRQPPGKGLEWIGSIYYSGITYYNPSLKSRVTISVDTSKNQFSLKLSSVTAADTAVYYCARHDGAVAGLFDYWGQGTLVTVSSASGGSGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 648 - DNA, 2166 bp, synthetic construct
  misc_feature 1..2166: note = MX852 Chain 1
  source 1..2166: mol_type = other DNA
agctacgtgctgacacaacctccatctgtgtctgtggcccctggccagacagccagaattacatgcggcggcaacaacatcggcagcaagtccgtgcattggtatcagcagcctccaggacaggctcctgtggtggtggtgtacgacgacagcgatagacctagcggcatccccgagagattcagcggcagcaatagcggcaataccgccacactgaccatcagcagagttgaggctggcgacgaggccgtgtactattgccaagtgtgggacagcagcagcgatcacgtggtgtttggcggcggaacaaagctgacagtgctcggcggatctggcggcgacatcgtgatgacccagacacctctgagcctgcctgtgacacctggcgaacctgccagcatcagctgcagaagcagcaagagcctgctgcacagcaacggcatcacctacctgtactggtatctgcagaaacccggccagtctcctcagctgctgatctaccagatgagcaacctggtgtccggcgtgcccgatagattttctggcagcggctctggcaccgacttcaccctgaagattagcagagtggaagccgaggacgtgggcgtgtactactgtgcccagaacctggaactgccctacacctttggcggaggcaccaaggtggaaatcaagggttctggcggcagcgccggaagtggtagtggtggcggaggatctgcttctggctctggacaggttcagctggttcagtctggcgccgaagtgaagaaacctggcagcagcgtgaaggtgtcctgcaaggcctctggctacgccttcagctacagctggatcaactgggtccgacaggcccctggacaaggcttggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtccagcggcggaagcggaggacagctccagctgcaagagtctggccctggactggtcaagcctagcgagacactgagcctgacatgtaccgtgtctggcggcagcatctccagcggctcctatttctggggctggatcagacaacctcctggcaaaggcctggaatggatcggctccatctactacagcggaatcacctactacaaccccagcctgaagtccagagtgaccatctccgtggacaccagcaagaaccagttctccctgaagctgagcagcgtgacagccgccgataccgccgtctattactgcgccagacatgatggcgctgtggccggcctgtttgattattggggacagggcaccctggtcaccgttagcagcgcttctggaggctccggagataagacccacacatgtcctccatgtcctgctccagaagctgctggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctggccgctcctatcgagaaaaccatcagcaaggccaagggccagcctagggaaccccaggtttacacccttcctccatgccgggatgagctgaccaagaaccaggtgtccctgtggtgtctcgtgaagggcttctaccccagcgacattgccgtggaatgggagagcaatggccagcctgagaacaactacaagacaacccctcctgtgctggacagcgacggctcattcttcctgtacagcaagctgacagtcgacaagtccagatggcagcagggcaacgtgttcagttgcagcgtgatgcacgaggccctgcacaaccactacacccagaagtccctgagcctgtctcctgga

SEQ ID NO: 649 - protein, 723 aa, synthetic construct; identical to SEQ ID NO: 641
  REGION 1..723: note = MX852 Chain 2

SEQ ID NO: 650 - DNA, 2169 bp, synthetic construct; identical to SEQ ID NO: 642
  misc_feature 1..2169: note = MX852 Chain 2
  source 1..2169: mol_type = other DNA

SEQ ID NO: 651 - protein, 722 aa, synthetic construct; identical to SEQ ID NO: 647
  REGION 1..722: note = MX853 Chain 1

SEQ ID NO: 652 - DNA, 2166 bp, synthetic construct; identical to SEQ ID NO: 648
  misc_feature 1..2166: note = MX853 Chain 1
  source 1..2166: mol_type = other DNA

SEQ ID NO: 653 - protein, 723 aa, synthetic construct; identical to SEQ ID NO: 645
  REGION 1..723: note = MX853 Chain 2

SEQ ID NO: 654 - DNA, 2169 bp, synthetic construct; identical to SEQ ID NO: 646
  misc_feature 1..2169: note = MX853 Chain 2
  source 1..2169: mol_type = other DNA

SEQ ID NO: 655 - protein, 724 aa, synthetic construct; identical to SEQ ID NO: 631
  REGION 1..724: note = MX854 Chain 1

SEQ ID NO: 656 - DNA, 2172 bp, synthetic construct; identical to SEQ ID NO: 632
  misc_feature 1..2172: note = MX854 Chain 1
  source 1..2172: mol_type = other DNA

SEQ ID NO: 657 - protein, 723 aa, synthetic construct; identical to SEQ ID NO: 641
  REGION 1..723: note = MX854 Chain 2

SEQ ID NO: 658 - DNA, 2169 bp, synthetic construct; identical to SEQ ID NO: 642
  misc_feature 1..2169: note = MX854 Chain 2
  source 1..2169: mol_type = other DNA

SEQ ID NO: 659 - protein, 724 aa, synthetic construct; identical to SEQ ID NO: 631
  REGION 1..724: note = MX855 Chain 1

SEQ ID NO: 660 - DNA, 2172 bp, synthetic construct; identical to SEQ ID NO: 632
  misc_feature 1..2172: note = MX855 Chain 1
  source 1..2172: mol_type = other DNA

SEQ ID NO: 661 - protein, 723 aa, synthetic construct; identical to SEQ ID NO: 645
  REGION 1..723: note = MX855 Chain 2

SEQ ID NO: 662 - DNA, 2169 bp, synthetic construct; identical to SEQ ID NO: 646
  misc_feature 1..2169: note = MX855 Chain 2
  source 1..2169: mol_type = other DNA

SEQ ID NO: 663 - protein, 476 aa, synthetic construct
  REGION 1..476: note = MX894  chain 1
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKGGGGSGGSGSGGGGSASGSGQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 664 - DNA, 1428 bp, synthetic construct
  misc_feature 1..1428: note = MX894  chain 1
  source 1..1428: mol_type = other DNA
gagatcgtgctgacacagagccctggcaccctgagcctgtctccaggcgagacagccatcatcagctgccggacaagccagtacggcagcctggcctggtatcagcagaggcctggacaggcccccagactcgtgatctacagcggcagcacaagagccgccggaatccccgatagattcagcggctccagatggggccctgactacaacctgaccatcagcaacctggaaagcggcgacttcggcgtgtactactgccagcagtacgagttcttcggccagggcaccaaggtgcaggtggacatcaagggcggcggaggaagcggcggatctggatctggtggcggaggatctgcttctggctctggacaggttcagctggttcagtctggcggacagatgaagaaacccggcgagagcatgcggatcagctgtagagccagcggctacgagttcatcgactgcaccctgaactggatcagactggcccctggcaaaagacccgagtggatgggatggctgaagcctagaggcggagccgtgaattacgccagacctctgcagggcagagtgaccatgaccagggacgtgtacagcgataccgccttcctggaactgagaagcctgaccgtggatgataccgccgtgtacttctgcacccggggcaagaactgcgactacaactgggacttcgagcactggggcagaggcacacctgtgatcgttagctctgctagcggaggttccggagataagacccacacatgtcctccatgtcctgctccagaactgctgggcggaccttccgtgtttctgttccctccaaagcctaaggacaccctgatgatcagcaggacccctgaagtgacctgcgtggtggtggatgtgtctcacgaggacccagaagtgaagttcaattggtacgtggacggcgtggaagtgcacaacgccaagaccaagcctagagaggaacagtacaacagcacctacagagtggtgtccgtgctgacagtgctgcaccaggattggctgaacggcaaagagtacaagtgcaaggtgtccaacaaggccctgcccgcccctatcgagaaaaccatcagcaaggccaagggccagcctagggaaccccaggtttacacccttcctccatgccgggatgagctgaccaagaaccaggtgtccctgtggtgtctggtcaagggcttctaccccagcgacattgccgtggaatgggagagcaatggccagcctgagaacaactacaagaccacacctcctgtgctggactccgacggatcattcttcctgtacagcaagctgactgtggacaagagcagatggcagcagggcaacgtgttcagctgcagcgtgatgcacgaggccctgcacaaccactacacacagaagtccctgtctctgagccctggc

SEQ ID NO: 665 - protein, 738 aa, synthetic construct; identical to SEQ ID NO: 136
  REGION 1..738: note = MX894  chain 2

SEQ ID NO: 666 - DNA, 2214 bp, synthetic construct; identical to SEQ ID NO: 148
  misc_feature 1..2214: note = MX894  chain 2
  source 1..2214: mol_type = other DNA

SEQ ID NO: 667 - protein, 758 aa, synthetic construct
  REGION 1..758: note = MX873  chain 1
QSVLTQPPSVSAAPGQKVTISCSGNTSNIGNNFVSWYQQRPGRAPQLLIYETDKRPSGIPDRFSASKSGTSGTLAITGLQTGDEADYYCATWAASLSSARVFGTGTKVIVLGGGGSSYVRPLSVALGETARISCGRQALGSRAVQWYQHRPGQAPILLIYNNQDRPSGIPERFSGTPDINFGTRATLTISGVEAGDEADYYCHMWDSRSGFSWSFGGATRLTVLGSGGSGGSGSGGGGSASGSGQVQLQESGPGLVKPSETLSVTCSVSGDSMNNYYWTWIRQSPGKGLEWIGYISDRESATYNPSLNSRVVISRDTSKNQLSLKLNSVTPADTAVYYCATARRGQRIYGVVSFGEFFYYYSMDVWGKGTTVTVSSGGGGSQVQLVESGGGVVQPGTSLRLSCAASQFRFDGYGMHWVRQAPGKGLEWVASISHDGIKKYHAEKVWGRFTISRDNSKNTLYLQMNSLRPEDTALYYCAKDLREDECEEWWSDYYDFGKQLPCAKSRGGLVGIADNWGQGTMVTVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVLHEALHSHYTQKSLSLSPG

SEQ ID NO: 668 - DNA, 2274 bp, synthetic construct
  misc_feature 1..2274: note = MX873  chain 1
  source 1..2274: mol_type = other DNA
cagtctgtgctgacacagcctccatccgtgtctgctgcccctggccagaaagtgaccatcagctgtagcggcaacaccagcaacatcggcaacaacttcgtgtcctggtatcagcagaggcccggcagagcacctcagctgctgatctacgagacagacaagaggcccagcggcatccccgatagattttccgccagcaagagcggcacctctggcacactggctatcacaggactgcagacaggcgacgaggccgattactactgtgctacatgggccgccagcctgtctagcgccagagtttttggcaccggcaccaaagtgatcgtgctgggcggaggcggttctagctacgtcagacctctgtctgtggccctgggagagacagccagaatcagctgtggcagacaggctctgggaagcagagccgtgcagtggtatcagcacagacctggacaggcccctatcctgctgatctacaacaaccaggacagacccagcggcatccccgagagattttctggcacccctgacatcaacttcggcaccagagccacactgaccatctctggcgttgaagccggcgacgaggccgattactactgtcacatgtgggacagcagaagcggcttcagctggtcttttggcggagccaccagactgacagtgctgggttctggcggaagcggaggatctggatctggtggtggtggatctgcttctggcagtggacaggttcagctgcaagagtctggccctggcctggtcaagcctagcgaaacactgagcgtgacctgtagcgtgtccggcgacagcatgaacaactactactggacctggatcagacagagccccggcaaaggcctggaatggatcggctacatcagcgacagagagagcgccacctacaatcccagcctgaacagcagagtggtcatcagccgggacaccagcaagaaccagctgagcctgaagctgaacagcgtgacccctgccgataccgccgtgtactattgtgccaccgccagaagaggccagcggatctatggcgtggtgtccttcggcgagttcttctactactacagcatggacgtgtggggcaagggcaccaccgtgacagtgtctagcggaggcggaggtagtcaggttcagctggtggaatctggtggcggagtggtgcagcctggcacatctctgagactgtcttgtgccgcctctcagttcagattcgacggctacggaatgcactgggtccgacaggcacctggcaaaggccttgaatgggtcgccagcatcagccacgacggcatcaagaagtaccacgccgagaaagtgtggggcagattcaccatcagccgggacaacagcaagaacaccctgtacctgcagatgaacagcctgcggcctgaggacacagccctgtactattgcgccaaggacctgcgcgaggacgagtgtgaagaatggtggagcgactactacgacttcggcaagcagctgccctgcgccaaaagtagaggtggccttgtgggaatcgccgacaactggggacagggcacaatggtcacagtgtcctctgcttctggcggctccggagataagacccacacatgtcctccatgtcctgctccagaactgctcggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgctcctatcgagaaaaccatcagcaaggccaagggccagcctagggaaccccaggtttacacccttcctccatgccgggatgagctgaccaagaaccaggtgtccctgtggtgtctcgtgaagggcttctaccccagcgacattgccgtggaatgggagagcaatggccagcctgagaacaactacaagacaacccctcctgtgctggacagcgacggctcattcttcctgtacagcaagctgacagtcgacaagtccagatggcagcagggcaacgtgttcagttgcagcgtgctgcacgaggccctgcacagtcactacacccagaagtccctgagcctgtctcctgga

SEQ ID NO: 669 - protein, 723 aa, synthetic construct
  REGION 1..723: note = MX873  chain 2
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKGGSSGSDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGGGGSGGSGSGGGGSASGSGQMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSGGSSGQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 670 - DNA, 2169 bp, synthetic construct; identical to SEQ ID NO: 145
  misc_feature 1..2169: note = MX873  chain 2
  source 1..2169: mol_type = other DNA

SEQ ID NO: 671 - protein, 758 aa, synthetic construct
  REGION 1..758: note = MX875  chain 1
SYVRPLSVALGETARISCGRQALGSRAVQWYQHRPGQAPILLIYNNQDRPSGIPERFSGTPDINFGTRATLTISGVEAGDEADYYCHMWDSRSGFSWSFGGATRLTVLGGGGSQSVLTQPPSVSAAPGQKVTISCSGNTSNIGNNFVSWYQQRPGRAPQLLIYETDKRPSGIPDRFSASKSGTSGTLAITGLQTGDEADYYCATWAASLSSARVFGTGTKVIVLGSGGSGGSGSGGGGSASGSGQVQLVESGGGVVQPGTSLRLSCAASQFRFDGYGMHWVRQAPGKGLEWVASISHDGIKKYHAEKVWGRFTISRDNSKNTLYLQMNSLRPEDTALYYCAKDLREDECEEWWSDYYDFGKQLPCAKSRGGLVGIADNWGQGTMVTVSSGGGGSQVQLQESGPGLVKPSETLSVTCSVSGDSMNNYYWTWIRQSPGKGLEWIGYISDRESATYNPSLNSRVVISRDTSKNQLSLKLNSVTPADTAVYYCATARRGQRIYGVVSFGEFFYYYSMDVWGKGTTVTVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVLHEALHSHYTQKSLSLSPG

SEQ ID NO: 672 - DNA, 2274 bp, synthetic construct
  misc_feature 1..2274: note = MX875  chain 1
  source 1..2274: mol_type = other DNA
agctacgtcagacctctgtctgtggccctgggagagacagccagaatcagctgtggcagacaggctctgggaagcagagccgtgcagtggtatcagcacagacctggacaggcccctatcctgctgatctacaacaaccaggacagacccagcggcatccccgagagattttctggcacccctgacatcaacttcggcaccagagccacactgaccatctctggcgttgaagccggcgacgaggccgattactactgtcacatgtgggacagcagaagcggcttcagctggtcttttggcggagccaccagactgacagtgctgggcggaggcggttctcagtctgtgctgacacagcctccatccgtgtctgctgcccctggccagaaagtgaccatcagctgtagcggcaacaccagcaacatcggcaacaacttcgtgtcctggtatcagcagaggcccggcagagcacctcagctgctgatctacgagacagacaagaggcccagcggcatccccgatagattttccgccagcaagagcggcacctctggcacactggctatcacaggactgcagacaggcgacgaggccgattactactgtgctacatgggccgccagcctgtctagcgccagagtttttggcaccggcaccaaagtgatcgtgctgggttctggcggaagcggaggatctggatctggtggtggtggatctgcttctggcagtggacaggttcagctggtggaatctggtggcggagtggtgcagcctggcacatctctgagactgtcttgtgccgcctctcagttcagattcgacggctacggaatgcactgggtccgacaggcacctggcaaaggccttgaatgggtcgccagcatcagccacgacggcatcaagaagtaccacgccgagaaagtgtggggcagattcaccatcagccgggacaacagcaagaacaccctgtacctgcagatgaacagcctgcggcctgaggacacagccctgtactattgcgccaaggacctgcgcgaggacgagtgtgaagaatggtggagcgactactacgacttcggcaagcagctgccctgcgccaaaagtagaggtggccttgtgggaatcgccgacaactggggacagggcacaatggtcacagtgtcctctggaggcggaggtagtcaggttcagctgcaagagtctggccctggcctggtcaagcctagcgaaacactgagcgtgacctgtagcgtgtccggcgacagcatgaacaactactactggacctggatcagacagagccccggcaaaggcctggaatggatcggctacatcagcgacagagagagcgccacctacaatcccagcctgaacagcagagtggtcatcagccgggacaccagcaagaaccagctgagcctgaagctgaacagcgtgacccctgccgataccgccgtgtactattgtgccaccgccagaagaggccagcggatctatggcgtggtgtccttcggcgagttcttctactactacagcatggacgtgtggggcaagggcaccaccgtgacagtgtctagcgcttctggcggctccggagataagacccacacatgtcctccatgtcctgctccagaactgctcggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgctcctatcgagaaaaccatcagcaaggccaagggccagcctagggaaccccaggtttacacccttcctccatgccgggatgagctgaccaagaaccaggtgtccctgtggtgtctcgtgaagggcttctaccccagcgacattgccgtggaatgggagagcaatggccagcctgagaacaactacaagacaacccctcctgtgctggacagcgacggctcattcttcctgtacagcaagctgacagtcgacaagtccagatggcagcagggcaacgtgttcagttgcagcgtgctgcacgaggccctgcacagtcactacacccagaagtccctgagcctgtctcctgga

SEQ ID NO: 673 - protein, 723 aa, synthetic construct; identical to SEQ ID NO: 669
  REGION 1..723: note = MX875  chain 2

SEQ ID NO: 674 - DNA, 2169 bp, synthetic construct; identical to SEQ ID NO: 145
  misc_feature 1..2169: note = MX875  chain 2
  source 1..2169: mol_type = other DNA

SEQ ID NO: 675 - protein, 758 aa, synthetic construct
  REGION 1..758: note = MX877  chain 1
QSVLTQPPSVSAAPGQKVTISCSGNTSNIGNNFVSWYQQRPGRAPQLLIYETDKRPSGIPDRFSASKSGTSGTLAITGLQTGDEADYYCATWAASLSSARVFGTGTKVIVLGGGGSESALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGSGGSGGSGSGGGGSASGSGEPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSGGGGSQVQLVESGGGVVQPGTSLRLSCAASQFRFDGYGMHWVRQAPGKGLEWVASISHDGIKKYHAEKVWGRFTISRDNSKNTLYLQMNSLRPEDTALYYCAKDLREDECEEWWSDYYDFGKQLPCAKSRGGLVGIADNWGQGTMVTVSSASGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVLHEALHSHYTQKSLSLSPG

SEQ ID NO: 676 - DNA, 2274 bp, synthetic construct
  misc_feature 1..2274: note = MX877  chain 1
  source 1..2274: mol_type = other DNA
cagtctgtgctgacacagcctccatccgtgtctgctgcccctggccagaaagtgaccatcagctgtagcggcaacaccagcaacatcggcaacaacttcgtgtcctggtatcagcagaggcccggcagagcacctcagctgctgatctacgagacagacaagaggcccagcggcatccccgatagattttccgccagcaagagcggcacctctggcacactggctatcacaggactgcagacaggcgacgaggccgattactactgtgctacatgggccgccagcctgtctagcgccagagtttttggcaccggcaccaaagtgatcgtgctgggcggaggcggttctgaaagcgctctgacccagcctccatctgcatctggaagccctggccagagcatcaccatcagctgtaccggcaccagcaacaacttcgtgtcctggtatcaacagcacgccggcaaggcccctaagctggtcatctacgacgtgaacaagaggccctccggcgtgcccgatagattcagcggctctaagtctggcaacaccgccagcctgactgtgtctggcctgcagacagatgatgaggccgtgtattactgcggcagcctcgtcggaaactgggacgtgatatttggaggcggcaccaagctgaccgtgctgggttctggcggaagcggaggatctggatctggtggtggtggatctgcttctggcagtggagaacctcagctccaagaaagcggccccacactggtggaagcctctgaaaccctgtctctgacctgtgccgtgtctggggattctaccgccgcctgcaatagcttctggggctgggttcgacagcctcctggaaagggactcgagtgggtcggaagcctgtctcactgtgccagctactggaacagaggctggacctatcacaaccctagcctgaagtccaggctgaccctggctctggacacccctaagaacctggtgttcctgaaactgaactccgtgacagccgccgacacagccacctactactgcgctagatttggcggcgaggtgctgagatacaccgactggcctaaacctgcctgggttgacctgtggggcagaggcacactggttaccgtgtcctctggaggcggaggtagtcaggttcagctggtggaatctggtggcggagtggtgcagcctggcacatctctgagactgtcttgtgccgcctctcagttcagattcgacggctacggaatgcactgggtccgacaggcacctggcaaaggccttgaatgggtcgccagcatcagccacgacggcatcaagaagtaccacgccgagaaagtgtggggcagattcaccatcagccgggacaacagcaagaacaccctgtacctgcagatgaacagcctgcggcctgaggacacagccctgtactattgcgccaaggacctgcgcgaggacgagtgtgaagaatggtggagcgactactacgacttcggcaagcagctgccctgcgccaaaagtagaggtggccttgtgggaatcgccgacaactggggacagggcacaatggtcacagtgtcctctgcttctggcggctccggagataagacccacacatgtcctccatgtcctgctccagaactgctcggcggcccttctgtgttcctgtttcctccaaagcctaaggacaccctgatgatcagcagaacccctgaagtgacctgcgtggtggtggatgtgtctcacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgctcctatcgagaaaaccatcagcaaggccaagggccagcctagggaaccccaggtttacacccttcctccatgccgggatgagctgaccaagaaccaggtgtccctgtggtgtctcgtgaagggcttctaccccagcgacattgccgtggaatgggagagcaatggccagcctgagaacaactacaagacaacccctcctgtgctggacagcgacggctcattcttcctgtacagcaagctgacagtcgacaagtccagatggcagcagggcaacgtgttcagttgcagcgtgctgcacgaggccctgcacagtcactacacccagaagtccctgagcctgtctcctgga

SEQ ID NO: 677 - protein, 723 aa, synthetic construct; identical to SEQ ID NO: 669
  REGION 1..723: note = MX877  chain 2

SEQ ID NO: 678 - DNA, 2169 bp, synthetic construct; identical to SEQ ID NO: 145
  misc_feature 1..2169: note = MX877  chain 2
  source 1..2169: mol_type = other DNA

SEQ ID NO: 679-682 - skipped (4 entries)

SEQ ID NO: 683 - protein, 5 aa, synthetic construct
  REGION 1..5: note = Amino acid linker
GGSGG

SEQ ID NO: 684 - protein, 20 aa, synthetic construct
  REGION 1..20: note = Amino acid linker
GSGGSAGSGSGGGGSASGSG

SEQ ID NO: 685 - protein, 5 aa, synthetic construct
  REGION 1..5: note = Amino acid linker
GGGGS

SEQ ID NO: 686 - protein, 20 aa, synthetic construct
  REGION 1..20: note = Amino acid linker
GSGGSGGSGSGGGGSASGSG

What is claimed is:
1. A polypeptide having at least 95% identity to any one of SEQ ID NOs: 30 and 32-43; wherein the polypeptide comprises the sequences of:
(i) a heavy chain complementarity determining region (CDR) 1 comprising the sequence of SEQ ID NO: 64; a heavy chain CDR2 comprising the sequence of SEQ ID NO: 65; a heavy chain CDR3 comprising the sequence of SEQ ID NO: 66; a light chain CDR1 comprising the sequence of SEQ ID NO: 67; a light chain CDR2 comprising the sequence of SEQ ID NO: 68; and a light chain CDR3 comprising the sequence of SEQ ID NO: 69;
(ii) a heavy chain CDR1 comprising the sequence of SEQ ID NO: 82; a heavy chain CDR2 comprising the sequence of SEQ ID NO: 83; a heavy chain CDR3 comprising the sequence of SEQ ID NO: 84; a light chain CDR1 comprising the sequence of SEQ ID NO: 85; a light chain CDR2 comprising the sequence of SEQ ID NO: 86; and a light chain CDR3 comprising the sequence of SEQ ID NO: 87; and
(iii) a heavy chain CDR1 comprising the sequence of SEQ ID NO: 88; a heavy chain CDR2 comprising the sequence of SEQ ID NO: 89; a heavy chain CDR3 comprising the sequence of SEQ ID NO: 90; a light chain CDR1 comprising the sequence of SEQ ID NO: 91; a light chain CDR2 comprising the sequence of SEQ ID NO: 92; and a light chain CDR3 comprising the sequence of SEQ ID NO: 93.
2. The polypeptide of claim 1, having at least 97% identity to any one of SEQ ID NOs: 30 and 32-43.
3. The polypeptide of claim 2, having the sequence of any one of SEQ ID NOs: 30 and 32-43.
4. The polypeptide of claim 1, having at least 95% identity to the sequence of SEQ ID NO:30.
5. The polypeptide of claim 1, having at least 95% identity to the sequence of SEQ ID NO:32.
6. The polypeptide of claim 1, having at least 95% identity to the sequence of SEQ ID NO: 33.
7. The polypeptide of claim 1, having at least 95% identity to the sequence of SEQ ID NO: 34.

8. The polypeptide of claim 1, having at least 95% identity to the sequence of SEQ ID NO: 35.
9. The polypeptide of claim 1, having at least 95% identity to the sequence of SEQ ID NO: 36.
10. The polypeptide of claim 1, having at least 95% identity to the sequence of SEQ ID NO: 37.
11. The polypeptide of claim 1, having at least 95% identity to the sequence of SEQ ID NO: 38.
12. The polypeptide of claim 1, having at least 95% identity to the sequence of SEQ ID NO: 39.
13. The polypeptide of claim 1, having at least 95% identity to the sequence of SEQ ID NO: 40.
14. The polypeptide of claim 1, having at least 95% identity to the sequence of SEQ ID NO: 41.
15. The polypeptide of claim 1, having at least 95% identity to the sequence of SEQ ID NO: 42.
16. The polypeptide of claim 1, having at least 95% identity to the sequence of SEQ ID NO: 43.
17. The polypeptide of claim 3, having the sequence of SEQ ID NO: 30.
18. The polypeptide of claim 3, having the sequence of SEQ ID NO: 32.
19. The polypeptide of claim 3, having the sequence of SEQ ID NO: 33.
20. The polypeptide of claim 3, having the sequence of SEQ ID NO: 37.
21. The polypeptide of claim 3, having the sequence of SEQ ID NO: 38.
22. The polypeptide of claim 3, having the sequence of SEQ ID NO: 39.
23. The polypeptide of claim 3, having the sequence of SEQ ID NO: 40.
24. The polypeptide of claim 3, having the sequence of SEQ ID NO: 41.
25. The polypeptide of claim 3, having the sequence of SEQ ID NO: 42.
26. The polypeptide of claim 3, having the sequence of SEQ ID NO: 43.

* * * * *